US012790614B2

(12) United States Patent
Thanos et al.

(10) Patent No.: US 12,790,614 B2
(45) Date of Patent: Nov. 10, 2026

(54) IMMUNOSTIMULATORY BACTERIA ENGINEERED TO COLONIZE TUMORS, TUMOR-RESIDENT IMMUNE CELLS, AND THE TUMOR MICROENVIRONMENT

(71) Applicant: ACTYM THERAPEUTICS, INC., Berkeley, CA (US)

(72) Inventors: Christopher D. Thanos, Tiburon, CA (US); Laura Hix Glickman, Oakland, CA (US); Justin Skoble, Berkeley, CA (US); Alexandre Charles Michel Iannello, San Diego, CA (US); Haixing Kehoe, Berkeley, CA (US)

(73) Assignee: Actym Therapeutics, Inc., Berkeley, CA (US)

( * ) Notice: Subject to any disclaimer, the term of this patent is extended or adjusted under 35 U.S.C. 154(b) by 182 days.

(21) Appl. No.: 17/573,569

(22) Filed: Jan. 11, 2022

(65) Prior Publication Data

US 2022/0135980 A1 May 5, 2022

Related U.S. Application Data

(63) Continuation of application No. 16/824,500, filed on Mar. 19, 2020, now Pat. No. 12,024,709, which is a continuation of application No. PCT/US2020/020240, filed on Feb. 27, 2020.

(60) Provisional application No. 62/962,140, filed on Jan. 16, 2020, provisional application No. 62/934,478, filed on Nov. 12, 2019, provisional application No. 62/828,990, filed on Apr. 3, 2019, provisional application No. 62/811,521, filed on Feb. 27, 2019.

(51) Int. Cl.
*A61K 35/74* (2015.01)
*A61K 38/19* (2006.01)
*C12N 1/36* (2006.01)
*C12N 15/113* (2010.01)
*C12N 15/74* (2006.01)

(52) U.S. Cl.
CPC .......... *C12N 15/1135* (2013.01); *A61K 35/74* (2013.01); *A61K 38/19* (2013.01); *C12N 1/36* (2013.01); *C12N 15/74* (2013.01); *C12N 2310/141* (2013.01); *C12N 2310/17* (2013.01); *C12N 2310/531* (2013.01)

(58) Field of Classification Search
CPC ...... C12N 15/1135; C12N 1/36; C12N 15/74; A61K 35/74; A61K 38/19
See application file for complete search history.

(56) References Cited

U.S. PATENT DOCUMENTS 3,536,809 A 10/1970 Applezweig .................... 424/28
3,598,123 A 8/1971 Zaffaroni ...................... 128/268
3,630,200 A 12/1971 Higuchi ........................ 128/260
3,710,795 A 1/1973 Higuchi et al. ............... 128/260
3,845,770 A 11/1974 Theeuwes et al. ........... 128/260
3,847,770 A 11/1974 Radlowe et al. ........ 204/159.23
3,916,899 A 11/1975 Theeuwes et al. ........... 128/260
3,936,354 A 2/1976 LaPointe et al. ............... 195/79
(Continued)

FOREIGN PATENT DOCUMENTS

AU 2005316458 6/2006
AU 2009279682 B2 2/2010
(Continued)

OTHER PUBLICATIONS

Conlon et al., The Journal of Immunology, 2013, 190: 5216-5225 (Year: 2013).*
Melki et al., J Allergy Clin Immunol 2017;140:543-52 (Year: 2017).*
Konno et al., Cell Rep. Apr. 24, 2018; 23(4): 1112-1123 (Year: 2018).*
(Continued)

*Primary Examiner* — Vanessa L. Ford
*Assistant Examiner* — Danaya L Middleton
(74) *Attorney, Agent, or Firm* — Womble Bond Dickinson (US) LLP; Stephanie Seidman

(57) ABSTRACT

Provided are delivery immunostimulatory bacteria that have enhanced colonization of tumors, the tumor microenvironment and/or tumor-resident immune cells, and enhanced anti-tumor activity. The immunostimulatory bacteria are modified by deletion of genes encoding the flagella or by modification of the genes so that functional flagella are not produced, and/or are modified by deletion of pagP or modification of pagP to produce inactive PagP product. As a result, the immunostimulatory bacteria are flagellin$^-$ and/or pagP$^-$. The immunostimulatory bacteria optionally have additional genomic modifications so that the bacteria are adenosine and/or purine auxotrophs. The bacteria optionally are one or more of asd$^-$, purI$^-$ and msbB$^-$. The immunostimulatory bacteria, such as *Salmonella* species, are modified to encode proteins that induce type I interferon (IFN) expression, or that are variants thereof that have increased activity to induce type I IFN expression, or that are variants thereof that result in constitutive expression of type I IFN. The bacteria can encode a modified Stimulator of Interferon Genes (STING) protein from a non-human species, that has lower NF-κB signaling activity, and, optionally, higher type I IFN pathway signaling activity, compared to human STING. The bacteria preferentially infect immune cells in the tumor microenvironment, or tumor-resident immune cells, and/or induce less cell death in immune cells than in other cells. Also provided are methods of inhibiting the growth or reducing the volume of a solid tumor by administering the immunostimulatory bacteria.

39 Claims, 13 Drawing Sheets

Specification includes a Sequence Listing.

(56) References Cited

U.S. PATENT DOCUMENTS

| | | | | |
|---|---|---|---|---|
| 4,008,719 | A | 2/1977 | Theeuwes et al. | 128/260 |
| 4,044,126 | A | 8/1977 | Cook et al. | 424/243 |
| 4,364,923 | A | 12/1982 | Cook et al. | 424/46 |
| 4,414,209 | A | 11/1983 | Cook et al. | 424/243 |
| 4,687,660 | A | 8/1987 | Baker et al. | 424/465 |
| 4,769,027 | A | 9/1988 | Baker et al. | 424/493 |
| 5,033,252 | A | 7/1991 | Carter | 53/425 |
| 5,052,558 | A | 10/1991 | Carter | 206/439 |
| 5,059,595 | A | 10/1991 | Le Grazie | 424/468 |
| 5,073,543 | A | 12/1991 | Marshall et al. | 514/21 |
| 5,120,548 | A | 6/1992 | McClelland et al. | 424/473 |
| 5,323,907 | A | 6/1994 | Kalvelage | 206/531 |
| 5,354,556 | A | 10/1994 | Sparks et al. | 424/419 |
| 5,591,767 | A | 1/1997 | Mohr et al. | 514/413 |
| 5,639,476 | A | 6/1997 | Oshlack et al. | 424/468 |
| 5,674,533 | A | 10/1997 | Santus et al. | 424/493 |
| 5,716,613 | A | 2/1998 | Guber et al. | 424/93.2 |
| 5,716,826 | A | 2/1998 | Gruber et al. | 435/320.1 |
| 5,733,566 | A | 3/1998 | Lewis | 424/426 |
| 5,851,529 | A | 12/1998 | Guber et al. | 424/188.1 |
| 5,997,881 | A | 12/1999 | Powell et al. | 424/234.1 |
| 6,024,961 | A | 2/2000 | Curtiss, III et al. | 424/200.1 |
| 6,080,849 | A | 6/2000 | Bermudes et al. | 536/23.7 |
| 6,190,657 | B1 | 2/2001 | Pawelek et al. | 424/93.1 |
| 6,383,496 | B1 | 5/2002 | Curtiss, III et al. | 424/200.1 |
| 6,428,968 | B1 | 8/2002 | Molnar-Kimber et al. | 435/7.23 |
| 6,447,784 | B1 | 9/2002 | Bermudes et al. | 424/235.1 |
| 6,475,482 | B1 | 11/2002 | Bermudes et al. | 424/93.4 |
| 6,548,287 | B1 | 4/2003 | Powell et al. | 435/243 |
| 6,632,670 | B1 | 10/2003 | Wadsworth et al. | 435/455 |
| 6,635,472 | B1 | 10/2003 | Lauermann | 435/320.1 |
| 6,639,139 | B2 | 10/2003 | Muller | 84/483.1 |
| 6,653,103 | B2 | 11/2003 | Petersen et al. | 435/69.1 |
| 6,689,871 | B1 | 2/2004 | Wolfe et al. | 530/412 |
| 6,723,316 | B2 | 4/2004 | Laquerre et al. | 424/93.2 |
| 6,863,894 | B2 | 3/2005 | Bermudes et al. | 424/235.1 |
| 6,897,045 | B2 | 5/2005 | Engelhardt et al. | 435/69.6 |
| 6,923,972 | B2 | 8/2005 | Bermudes et al. | 424/235.1 |
| 6,962,696 | B1 | 11/2005 | Bermudes et al. | 424/93.4 |
| 7,001,765 | B2 | 2/2006 | Maass et al. | 435/320.1 |
| 7,033,826 | B2 | 4/2006 | Perricaudet et al. | 435/320.1 |
| 7,083,794 | B2 | 8/2006 | Curtiss, III et al. | 424/200.1 |
| 7,115,269 | B2 | 10/2006 | Darji et al. | 424/200.1 |
| 7,153,510 | B1 | 12/2006 | Rose | 424/199.1 |
| 7,172,893 | B2 | 2/2007 | Rabinowitz et al. | 435/235.1 |
| 7,195,757 | B2 | 3/2007 | Curtiss, III et al. | 424/93.48 |
| 7,238,526 | B2 | 7/2007 | Wilson et al. | 435/382 |
| 7,241,447 | B1 | 7/2007 | Engelhardt et al. | 424/193.1 |
| 7,344,710 | B2 | 3/2008 | Dang et al. | 424/93.1 |
| 7,354,592 | B2 | 4/2008 | Bermudes et al. | 424/235.1 |
| 7,390,646 | B2 | 6/2008 | Andino-Pavlovsky et al. | 435/252.33 |
| 7,452,531 | B2 | 11/2008 | Bermudes et al. | 424/93.2 |
| 7,514,089 | B2 | 4/2009 | Bermudes et al. | 424/285.1 |
| 7,537,924 | B2 | 5/2009 | Coffin | 435/235.1 |
| 7,550,296 | B2 | 6/2009 | Hermiston et al. | 435/473 |
| 7,588,767 | B2 | 9/2009 | Szalay et al. | 424/199.1 |
| 7,662,627 | B2 | 2/2010 | Johnson, Jr. | 435/367 |
| 7,731,952 | B2 | 6/2010 | Mohr et al. | 424/93.2 |
| 7,731,974 | B2 | 6/2010 | Bell et al. | 424/199.1 |
| 7,811,814 | B2 | 10/2010 | Bohn et al. | 435/320.1 |
| 7,892,740 | B2 | 2/2011 | Weichselbaum et al. | 435/6 |
| 7,897,146 | B2 | 3/2011 | Brown et al. | 424/93.1 |
| 7,906,111 | B2 | 3/2011 | Wilson et al. | 424/93.2 |
| 7,927,585 | B2 | 4/2011 | Snyder | 424/93.2 |
| 7,943,374 | B2 | 5/2011 | Hildinger | 435/320.1 |
| 7,968,340 | B2 | 6/2011 | Hallek et al. | 435/440 |
| 7,998,461 | B2 | 8/2011 | Forbes et al. | 424/9.2 |
| 8,007,780 | B2 | 8/2011 | Arbetman et al. | 424/93.2 |
| 8,052,968 | B2 | 11/2011 | Chen et al. | 424/93.21 |
| 8,093,025 | B2 | 1/2012 | Loessner et al. | 435/172.1 |
| 8,221,739 | B2 | 7/2012 | Leonard et al. | 424/93.2 |
| 8,232,259 | B2 | 7/2012 | Klinman et al. | 514/44 R |
| 8,241,844 | B2 | 8/2012 | Bulla, Jr. et al. | 435/5 |
| 8,426,375 | B2 | 4/2013 | Kandimalla et al. | 514/44 |
| 8,426,675 | B2 | 4/2013 | Dickins et al. | 800/14 |
| 8,440,207 | B2 | 5/2013 | Bermudes | 424/258.1 |
| 8,524,220 | B1 | 9/2013 | Bermudes | 424/93.2 |
| 8,647,618 | B2 | 2/2014 | Leonard et al. | 424/93.48 |
| 8,647,642 | B2 | 2/2014 | Bermudes | 424/258.1 |
| 8,679,473 | B2 | 3/2014 | Fensterle et al. | 424/93.1 |
| 8,822,194 | B2 | 9/2014 | Zhao et al. | 435/252.3 |
| 9,068,187 | B1 | 6/2015 | Bermudes | 424/93.2 |
| 9,181,546 | B2 | 11/2015 | Li et al. | 424/93.1 |
| 9,265,804 | B2 | 2/2016 | Newman | 424/93.48 |
| 9,315,817 | B2 | 4/2016 | Bermudes | 435/252.3 |
| 9,320,787 | B2 | 4/2016 | Gunn | 424/257.1 |
| 9,415,098 | B2 | 8/2016 | Lubenau | 424/258.1 |
| 9,421,252 | B2 | 8/2016 | Bermudes | 424/258.1 |
| 9,453,227 | B2 | 9/2016 | Diamond et al. | 424/258.1 |
| 9,511,129 | B2 | 12/2016 | Hanson et al. | 435/821 |
| 9,616,114 | B1 | 4/2017 | Bermudes | 424/258.1 |
| 9,731,011 | B2 | 8/2017 | Brahmbhatt et al. | 424/197.11 |
| 9,790,504 | B2 | 10/2017 | Khodarev et al. | 514/44 A |
| 9,878,023 | B1 | 1/2018 | Bermudes | 424/93.2 |
| 10,052,371 | B2 | 8/2018 | Newman | 424/93.48 |
| 10,087,451 | B2 | 10/2018 | Bermudes | 424/258.1 |
| 10,100,314 | B2 | 10/2018 | Diamond et al. | 424/258.1 |
| 10,188,722 | B2 | 1/2019 | Bermudes | 424/258.1 |
| 10,195,259 | B2 | 2/2019 | Newman | 530/388.4 |
| 10,286,051 | B1 | 5/2019 | Bermudes | 424/258.1 |
| 10,293,037 | B2 | 5/2019 | Lubenau | 424/185.1 |
| 10,413,612 | B2 | 9/2019 | Goldberg et al. | 424/85.5 |
| 10,421,971 | B2 | 9/2019 | Deng et al. | 514/44 R |
| 10,449,237 | B1 | 10/2019 | Bermudes | 424/258.1 |
| 10,500,277 | B2 | 12/2019 | Brahmbhatt et al. | 424/197.11 |
| 10,525,082 | B2 | 1/2020 | Crane et al. | 424/130.1 |
| 10,584,339 | B2 | 3/2020 | Diamond et al. | 424/93.2 |
| 10,626,403 | B2 | 4/2020 | Bermudes | 424/258.1 |
| 10,653,774 | B2 | 5/2020 | Dubensky, Jr. et al. | 424/184.1 |
| 10,729,731 | B1 | 8/2020 | Bermudes | 424/200.1 |
| 10,774,354 | B2 | 9/2020 | Yam et al. | 435/69.1 |
| 10,821,163 | B2 | 11/2020 | Lubenau | 424/186.1 |
| 10,828,356 | B1 | 11/2020 | Bermudes | 424/200.1 |
| 11,045,504 | B2 | 6/2021 | Newman | 530/388.4 |
| 11,103,538 | B2 | 8/2021 | Forbes et al. | 424/93.2 |
| 11,141,492 | B2 | 10/2021 | Diamond et al. | 424/93.48 |
| 11,174,486 | B2 | 11/2021 | Hasty et al. | 424/184.1 |
| 11,471,494 | B2 | 10/2022 | Falb et al. | 424/93.4 |
| 11,590,215 | B2 | 2/2023 | Lubenau | 424/186.1 |
| 11,613,758 | B2 | 3/2023 | Hasty et al. | 424/184.1 |
| 11,723,932 | B2 | 8/2023 | Falb et al. | 424/93.2 |
| 12,024,709 | B2 | 7/2024 | Thanos et al. | 424/94.1 |
| 2002/0026655 | A1 | 2/2002 | Bermudes et al. | 424/235.1 |
| 2003/0031683 | A1 | 2/2003 | Curtiss, III et al. | 424/200.1 |
| 2003/0109026 | A1 | 6/2003 | Bermudes et al. | 424/235.1 |
| 2003/0170276 | A1 | 9/2003 | Bermudes et al. | 424/235.1 |
| 2003/0175297 | A1 | 9/2003 | Urashima | 424/190.1 |
| 2004/0009604 | A1 | 1/2004 | Zhang et al. | 514/44 |
| 2004/0120962 | A1 | 6/2004 | Curtiss, III et al. | 424/93.48 |
| 2004/0171823 | A1 | 9/2004 | Nadler et al. | 514/12 |
| 2004/0229338 | A1 | 11/2004 | King et al. | 424/93.4 |
| 2004/0234455 | A1 | 11/2004 | Szalay et al. | 424/93.2 |
| 2005/0220818 | A1 | 10/2005 | Lorencc | 435/6 |
| 2005/0244375 | A1 | 11/2005 | Lconard et al. | 424/93.2 |
| 2005/0255088 | A1 | 11/2005 | Bermudes et al. | 424/93.2 |
| 2005/0260601 | A1 | 11/2005 | Whitt et al. | 514/44 |
| 2006/0039894 | A1 | 2/2006 | Mohr et al. | 435/235.1 |
| 2006/0051380 | A1 | 3/2006 | Schulick et al. | 424/277.1 |
| 2007/0009489 | A1 | 1/2007 | Bermudes et al. | 369/30.31 |
| 2007/0098743 | A1 | 5/2007 | Bell et al. | 424/199.1 |
| 2007/0110720 | A1 | 5/2007 | Brown et al. | 435/320.1 |
| 2007/0298012 | A1 | 12/2007 | King et al. | 424/93.2 |
| 2008/0112928 | A1 | 5/2008 | Loessner et al. | 435/69.5 |
| 2009/0010889 | A1 | 1/2009 | Brown et al. | 424/93.2 |
| 2009/0011439 | A1 | 1/2009 | Weichselbaum et al. | 435/6 |
| 2009/0123426 | A1 | 5/2009 | Li et al. | 424/93.1 |
| 2009/0169517 | A1 | 7/2009 | Bermudes et al. | 424/93.4 |
| 2009/0175829 | A1 | 7/2009 | Forbes et al. | 424/9.2 |
| 2009/0208534 | A1 | 8/2009 | Xu et al. | 424/93.2 |
| 2009/0215147 | A1 | 8/2009 | Zhang et al. | 424/93.2 |
| 2009/0274728 | A1 | 11/2009 | Brown et al. | 514/44 |
| 2009/0285860 | A1 | 11/2009 | Martuza et al. | 435/5 |
| 2010/0092515 | A1 | 4/2010 | Conner et al. | 424/199.1 |

(56) References Cited

U.S. PATENT DOCUMENTS

| | | | | |
|---|---|---|---|---|
| 2010/0098665 | A1 | 4/2010 | Leonard et al. | 424/93.2 |
| 2010/0113567 | A1 | 5/2010 | Barber | 424/93.21 |
| 2010/0135961 | A1 | 6/2010 | Bermudes | 424/258.1 |
| 2010/0172877 | A1 | 7/2010 | van den Pol et al. | 435/235.1 |
| 2010/0178684 | A1 | 7/2010 | Woo et al. | 435/235.1 |
| 2011/0158948 | A1 | 6/2011 | Brown et al. | 424/93.2 |
| 2011/0177032 | A1 | 7/2011 | Martuza et al. | 424/93.2 |
| 2011/0200998 | A1 | 8/2011 | Weichselbaum et al. | 435/6 |
| 2011/0212530 | A1 | 9/2011 | Baltimore et al. | 424/93.6 |
| 2011/0262485 | A1 | 10/2011 | Barber | 530/389.6 |
| 2011/0293527 | A1 | 12/2011 | Chen et al. | 424/93.3 |
| 2012/0009153 | A1 | 1/2012 | Guo et al. | 424/93.2 |
| 2012/0093773 | A1 | 4/2012 | Li et al. | 424/93.1 |
| 2012/0142080 | A1 | 6/2012 | Bermudes | 424/200.1 |
| 2013/0045525 | A1 | 2/2013 | Leonard et al. | 424/93.48 |
| 2013/0150258 | A1 | 6/2013 | Weichselbaum et al. | 435/6 |
| 2013/0337066 | A1 | 12/2013 | Zhang et al. | 424/489 |
| 2014/0093557 | A1 | 4/2014 | Zhang | 424/450 |
| 2014/0127284 | A1 | 5/2014 | Cheresh et al. | 514/44 R |
| 2014/0127816 | A1 | 5/2014 | Hanson et al. | 435/821 |
| 2014/0178341 | A1 | 6/2014 | Zhao et al. | 435/7.32 |
| 2014/0186401 | A1 | 7/2014 | Diamond et al. | 424/258.1 |
| 2014/0212396 | A1 | 7/2014 | Newman | 424/93.48 |
| 2014/0220661 | A1 | 8/2014 | Bermudes | 435/252.3 |
| 2015/0017204 | A1 | 1/2015 | Bermudes | 424/258.1 |
| 2015/0071873 | A1 | 3/2015 | Biot | 424/168.1 |
| 2015/0098897 | A1 | 4/2015 | Brahmbhatt et al. | 424/197.11 |
| 2015/0147315 | A1 | 5/2015 | Wei | 435/7.32 |
| 2015/0165011 | A1 | 6/2015 | Lubenau | 424/258.1 |
| 2015/0224151 | A1 | 8/2015 | Julian Gomez et al. | 424/93.4 |
| 2015/0232880 | A1 | 8/2015 | Hemminki et al. | 424/93.1 |
| 2016/0184456 | A1 | 6/2016 | Diamond et al. | 424/93.48 |
| 2016/0199422 | A1 | 7/2016 | Newman | 424/93.48 |
| 2016/0222387 | A1 | 8/2016 | Khodarev et al. | 514/44 A |
| 2016/0222393 | A1 | 8/2016 | Bermudes | 424/258.1 |
| 2016/0228523 | A1 | 8/2016 | Newman | 530/388.4 |
| 2016/0250311 | A1 | 9/2016 | Lubenau | 424/258.1 |
| 2016/0333355 | A1 | 11/2016 | Deng et al. | 514/44 R |
| 2016/0369282 | A1 | 12/2016 | Li et al. | 424/93.1 |
| 2017/0020931 | A1 | 1/2017 | Zhou et al. | 424/144.1 |
| 2017/0081671 | A1 | 3/2017 | Diamond et al. | 424/258.1 |
| 2017/0081673 | A1 | 3/2017 | Hanson et al. | 435/821 |
| 2017/0157239 | A1 | 6/2017 | Bermudes | 424/258.1 |
| 2017/0298362 | A1 | 10/2017 | Khodarev et al. | 514/44 A |
| 2017/0326235 | A1 | 11/2017 | Brahmbhatt et al. | 424/197.11 |
| 2017/0333490 | A1 | 11/2017 | Forbes et al. | 424/93.2 |
| 2018/0085432 | A1 | 3/2018 | Barber | 424/185.1 |
| 2018/0104187 | A1 | 4/2018 | Liu et al. | 435/7.23 |
| 2018/0104320 | A1 | 4/2018 | Gravekamp | 424/236.1 |
| 2018/0148729 | A1 | 5/2018 | Hasty et al. | 424/184.1 |
| 2018/0193266 | A1 | 7/2018 | Zhang | 424/450 |
| 2018/0236104 | A1 | 8/2018 | Lötvall et al. | 514/44 |
| 2018/0311343 | A1 | 11/2018 | Huang et al. | 514/44 R |
| 2019/0008936 | A1 | 1/2019 | Lubenau | 424/185.1 |
| 2019/0017050 | A1 | 1/2019 | Thanos et al. | 424/258.1 |
| 2019/0017057 | A1 | 1/2019 | Bermudes | 424/258.1 |
| 2019/0071679 | A1 | 3/2019 | Khodarev et al. | 514/44 A |
| 2019/0153452 | A1 | 5/2019 | Diamond et al. | 424/258.1 |
| 2019/0160115 | A1 | 5/2019 | Falb et al. | 424/93.2 |
| 2019/0183996 | A1 | 6/2019 | Lubenau | 424/186.1 |
| 2019/0307869 | A1 | 10/2019 | Newman | 530/388.4 |
| 2019/0336544 | A1 | 11/2019 | Falb et al. | 424/93.4 |
| 2020/0023053 | A1 | 1/2020 | Bermudes | 424/200.1 |
| 2020/0055904 | A1 | 2/2020 | Erhardt et al. | 424/258.1 |
| 2020/0149053 | A1* | 5/2020 | Fisher et al. | A61K 35/66 |
| 2020/0157549 | A1 | 5/2020 | Diamond et al. | 484/258.1 |
| 2020/0215123 | A1 | 7/2020 | Thanos et al. | 424/93.4 |
| 2020/0261572 | A1 | 8/2020 | Huang et al. | 514/44 R |
| 2020/0270613 | A1 | 8/2020 | Thanos et al. | 424/94.1 |
| 2021/0017541 | A1 | 1/2021 | Barber | 514/44 R |
| 2022/0047649 | A1 | 2/2022 | Newman | 424/277.1 |
| 2022/0072112 | A1 | 3/2022 | Lubenau | 424/186.1 |
| 2022/0119824 | A1 | 4/2022 | Glickman et al. | 424/185.1 |
| 2022/0154136 | A1 | 5/2022 | Thanos et al. | 530/351 |
| 2022/0241432 | A1 | 8/2022 | Diamond et al. | 424/93.48 |
| 2022/0251579 | A1 | 8/2022 | Hasty et al. | 424/184.1 |
| 2022/0380720 | A1 | 12/2022 | Glickman et al. | 530/351 |
| 2023/0226122 | A1 | 7/2023 | Falb et al. | 424/93.4 |
| 2024/0180974 | A1 | 6/2024 | Falb et al. | 424/93.2 |

FOREIGN PATENT DOCUMENTS

| | | | |
|---|---|---|---|
| AU | 2015202068 | B2 | 5/2015 |
| AU | 2017254892 | A1 | 2/2018 |
| CA | 2591565 | | 6/2006 |
| CN | 103468626 | B | 5/2016 |
| CN | 108064176 | A | 5/2018 |
| CN | 108795832 | A | 11/2018 |
| CN | 110430894 | A | 11/2019 |
| EP | 1 655 370 | | 5/2006 |
| EP | 1520175 | | 11/2007 |
| EP | 1606411 | | 12/2008 |
| EP | 2 270 136 | | 1/2011 |
| EP | 1385466 | | 3/2011 |
| EP | 2 941 258 | B1 | 9/2019 |
| JP | 2007-306911 | A | 11/2007 |
| KR | 10-2018-0066296 | | 6/2018 |
| WO | WO 1998/048026 | | 10/1998 |
| WO | WO 1999/013053 | | 3/1999 |
| WO | WO 1999/025387 | | 5/1999 |
| WO | WO 2001/025399 | | 4/2001 |
| WO | WO 2002/059292 | | 8/2002 |
| WO | WO 2003/087768 | A2 | 10/2003 |
| WO | WO 2003/096812 | | 11/2003 |
| WO | WO 2005/116233 | | 12/2005 |
| WO | WO 2006/048344 | | 5/2006 |
| WO | WO 2006/066048 | | 6/2006 |
| WO | WO 2007/084992 | | 7/2007 |
| WO | WO 2007/112518 | | 10/2007 |
| WO | WO 2008/039408 | | 4/2008 |
| WO | WO 2008/091375 | | 7/2008 |
| WO | WO 2009/095436 | | 8/2009 |
| WO | WO 2010/010983 | | 1/2010 |
| WO | WO 2010/017248 | | 2/2010 |
| WO | WO 2010/017515 | A2 | 2/2010 |
| WO | WO 2010/045620 | | 4/2010 |
| WO | WO 2010/132341 | A2 | 11/2010 |
| WO | WO 2011/100489 | | 8/2011 |
| WO | WO 2011/150421 | | 12/2011 |
| WO | WO 2012/149364 | | 11/2012 |
| WO | WO 2013/148328 | A1 | 10/2013 |
| WO | WO 2013/163893 | | 11/2013 |
| WO | WO 2014/005683 | | 1/2014 |
| WO | WO 2014/107365 | | 7/2014 |
| WO | WO 2014/189996 | | 11/2014 |
| WO | WO 2015/002969 | | 1/2015 |
| WO | WO 2015/017652 | A1 | 2/2015 |
| WO | WO 2015/032165 | | 3/2015 |
| WO | WO 2015/059303 | | 4/2015 |
| WO | WO 2015/108595 | | 7/2015 |
| WO | WO 2015/126921 | A1 | 8/2015 |
| WO | WO 2015/134722 | | 9/2015 |
| WO | WO 2015/142875 | | 9/2015 |
| WO | WO 2016/025582 | | 2/2016 |
| WO | WO 2016/164636 | | 10/2016 |
| WO | WO 2016/170176 | | 10/2016 |
| WO | WO 2017/027645 | A1 | 2/2017 |
| WO | WO 2017/043815 | | 3/2017 |
| WO | WO 2017/044487 | | 3/2017 |
| WO | WO 2017/123675 | | 7/2017 |
| WO | WO 2017/156349 | | 9/2017 |
| WO | WO 2018/006005 | | 1/2018 |
| WO | WO 2018/011289 | | 1/2018 |
| WO | WO 2018/031419 | | 2/2018 |
| WO | WO 2018/081459 | | 5/2018 |
| WO | WO 2018/106754 | | 6/2018 |
| WO | WO 2018/115140 | | 6/2018 |
| WO | WO 2018/129404 | | 7/2018 |
| WO | WO 2018/144775 | | 8/2018 |
| WO | WO 2018/160540 | A1 | 9/2018 |
| WO | WO 2018/191619 | | 10/2018 |
| WO | WO 2018/191654 | | 10/2018 |
| WO | WO 2018/197621 | | 11/2018 |
| WO | WO 2019/014398 | | 1/2019 |

(56) References Cited

FOREIGN PATENT DOCUMENTS

| | | | |
|---|---|---|---|
| WO | WO 2019/035901 | 2/2019 | |
| WO | WO-2019035901 A9 * | 4/2019 | ......... A61K 31/4545 |
| WO | WO 2019/150310 | 8/2019 | |
| WO | WO 2019/183117 | 9/2019 | |
| WO | WO 2020/014543 | 1/2020 | |
| WO | WO 2021/097144 | 5/2021 | |

OTHER PUBLICATIONS

Lazar et al. Transforming Growth Factor alpha: Mutation of Aspartic Acid 47 and Leucine 48 Results in Different Biological Activities . Mol. Cell. Biol., 8:1247-1252, 1988 (Year: 1988).*
Bowie et al. Deciphering the Message in Protein Sequences: Tolerance to Amino Acid Substitutions. Science, 1990, 247:1306-1310 (Year: 1990).*
Burgess et al. Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue. J. Cell Biol. 111:2129-2138, 1990 (Year: 1990).*
Greenspan et al. 1999 Defining epitopes: It's not as easy as it seems; Nature Biotechnology, 17:936-937 (Year: 1999).*
Bork. Powers and Pitfalls in Sequence Analysis: The 70% Hurdle. Genome Research, 2000, 10:398-400 (Year: 2000).*
Skolnick et al., Trends Biotechnol. Jan. 2000;18(1):34-9 (Year: 2000).*
Trompouki et al., Nature, vol. 424: 793-796; publication date: Aug. 14, 2003 (Year: 2003).*
Avogadri, F., Martinoli, C., Petrovska, L., Chiodoni, C., Transidico, P., Bronte, V., . . . & Rescigno, M. (2005). Cancer immunotherapy based on killing of *Salmonella*-infected tumor cells. Cancer research, 65(9), 3920-3927 (Year: 2005).*
Crull, K., Bumann, D., & Weiss, S. (2011). Influence of infection route and virulence factors on colonization of solid tumors by *Salmonella enterica serovar Typhimurium*. FEMS Immunology & Medical Microbiology, 62(1), 75-83. (Year: 2011).*
Kong, Q., Six, D. A., Liu, Q., Gu, L., Roland, K. L., Raetz, C. R., & Curtiss III, R. (2011). Palmitoylation state impacts induction of innate and acquired immunity by the *Salmonella enterica* serovar Typhimurium msbB mutant. Infection and immunity, 79(12), 5027-5038 (Year: 2011).*
Miller et al., PNAS 108(3): 12348-12353, publication date: Jul. 26, 2011 (Year: 2011).*
Abe, T., & Barber, G. N. (2014). Cytosolic-DNA-mediated, STING-dependent proinflammatory gene induction necessitates canonical NF-κB activation through TBK1. Journal of virology, 88(10), 5328-5341 (Year: 2014).*
Miosge, Proc Natl Acad Sci U S A. Sep. 15, 2015;112(37):E5189-98 (Year: 2015).*
Konno, H., Chinn, I. K., Hong, D., Orange, J. S., Lupski, J. R., Mendoza, A., . . . & Barber, G. N. (2018). Pro-inflammation associated with a gain-of-function mutation (R284S) in the innate immune sensor STING. Cell reports, 23(4), 1112-1123; IDS Jun. 18, 2020 (Year : 2018).*
Keskitalo et al., BioRxiv, doi: https://doi.org/10.1101/394353; publication date: Aug. 17, 2018 (Year: 2018).*
Kulmanov et al., Bioinformatics, 34(4), 2018, 660-668 (Year: 2018).*
De Oliveira Mann et al., 2019, Cell Reports 27, 1165-1175 (Year: 2019).*
Mott et al, J. Mol. Biol. (1995) 247, 979-994 (Year: 1995).*
Wang et al, Developmental and Comparative Immunology 115 (2021) 103895 (Year: 2021).*
Dashwood et al, Computational and Structural Biotechnology Journal 27 (2025) 1112-1123 (Year: 2025).*
Letter/Written Disclosure of the Supplemental Information Disclosure Statement for the above-referenced application, filed herewith on Feb. 23, 2023, 2 pages.
Allen et al., "Linear doggybone DNA vaccine induces similar immunological responses to conventional plasmid DNA independently of immune recognition by TLR9 in a pre-clinical model," Cancer Immunology, Immunotherapy 67:627-638 (2018), 11 pages.
Bereta et al., "Improving tumor targeting and therapeutic potential of *Salmonella* VNP20009 by displaying cell surface CEA-specific antibodies," Vaccine 25(21): 4183-4192 (2007), 9 pages.
Crull ct al., "Influence of infection route and virulence factors on colonization of solid tumors by *Salmonella enterica* serovar Typhimurium," FEMS Immunol. Med. Microbiol. 62:75-83 (2011), 8 pages.
Felgner et al., "Bacteria in Cancer Therapy: Renaissance of an Old Concept," International Journal of Microbiology 2016:8451728 (2016), 14 pages.
Gahan et al., "Impact of plasmid stability on oral DNA delivery by *Salmonella enterica* serovar Typhimurium," Vaccine 25:1476-1483 (2007), 7 pages.
Haque, S. and Morris, J.C., "Transforming growth factor-β: A therapeutic target for cancer," Human Vaccines & Immunotherapeutics 13(8):1741-1750 (2017), 9 pages.
Leschner, S. and S. Weiss, "*Salmonella*—allies in the fight against cancer," J. Mol. Med. 88:763-773 (2010), 10 pages.
Mcfarland, W. C., and Bruce A. D. Stocker, "Effect of different purine auxotrophic mutations on mouse-virulence of a Vi-positive strain of *Salmonella dublin* and of two strains of *Salmonella typhimurium*," Microbial Pathogenesis 3:129-141 (1987), 12 pages.
Miller et al., "Genetic diversity and population structure of the endangered marsupial *Sarcophilus harrisii* (Tasmanian devil)," Proc. Natl. Acad. Sci. U.S.A. 108(30):12348-12353 (2011), 5 pages.
Paglia et al., "Gene Transfer in Dendritic Cells, Induced by Oral DNA Vaccination With *Salmonella typhimurium*, Results in Protective Immunity Against a Murine Fibrosarcoma," Blood 92(9):3172-3176 (1998), 4 pages.
Wu, J., "IL-15 Agonists: The Cancer Cure Cytokine," J. Mol. Genet. Med. 7:85, doi: 10.4172/1747-0862.1000085 (2013), 3 pages.
Response, filed Apr. 6, 2022, to Decision of Rejection, mailed Jan. 25, 2022, in connection with Japanese Patent Application No. 2020-523685 [English instructions; original document as filed in Japanese; and English translation of the pending claims], 21 pages.
Decision to Grant, issued May 31, 2022, in connection with Japanese Patent Application No. 2020-523685 [English reporting letter, and original document as issued in Japanese], 5 pages.
Office Action, issued Scp. 30, 2021, in connection with U.S. Appl. No. 16/520,155, 7 pages.
Response, filed Oct. 25, 2021, to Office Action, issued Sep. 30, 2021, in connection with U.S. Appl. No. 16/520,155, 47 pages.
Notice of Allowance, mailed Mar. 11, 2022, in connection with U.S. Appl. No. 16/520,155, 8 pages.
Notification of Reopening of Prosecution Due to Consideration of an Information Disclosure Statement Filed After Mailing of a Notice of Allowance, mailed Sep. 12, 2022, in connection with U.S. Appl. No. 16/520,155, 3 pages.
Office Action, dated Oct. 7, 2022, in connection with U.S. Appl. No. 16/520,155, 14 pages.
Office Action, dated May 26, 2022, in connection with U.S. Appl. No. 17/037,455, 8 pages.
Response, filed Jun. 1, 2022, to Office Action, dated May 26, 2022, in connection with U.S. Appl. No. 17/037,455, 7 pages.
Notice of Allowance, mailed Jun. 15, 2022, in connection with U.S. Appl. No. 17/037,455, 9 pages.
Notification of Reopening of Prosecution Due to Consideration of an Information Disclosure Statement Filed After Mailing of a Notice of Allowance, mailed Oct. 26, 2022, in connection with U.S. Appl. No. 17/037,455, 3 pages.
Office Action, dated Feb. 7, 2023, in connection with U.S. Appl. No. 17/037,455, 30 pages.
Examination Report, dated Oct. 8, 2022, in connection with Australian Patent Application No. 2019301699, 3 pages.
Response, filed Apr. 22, 2022, to Examiner's Report, dated Dec. 24, 2021, in connection with Canadian Patent Application No. 3,106,143, 57 pages.
Examiner's Report, dated Dec. 23, 2022, in connection with Canadian Patent Application No. 3,106,143, 5 pages.

(56) References Cited

OTHER PUBLICATIONS

Examiner's Report, dated Dec. 9, 2022, in connection with Canadian Patent Application No. 3,176,812, 4 pages.
Office Action, issued Aug. 29, 2022, in connection with Chinese Patent Application No. 201980059088.5 [English translation of office action; and original document as issued in Chinese], 10 pages.
Communication pursuant to Rule 164(2)(b) and Article 94(3) EPC (Examination Report), dated Sep. 15, 2022, issued in connection with European Patent Application No. 19 745 021.6, 11 pages.
Office Action, issued Dec. 20, 2022, in connection with Japanese Patent Application No. 2021-500579 [Document as issued in Japanese; English summary of Office Action; and English translation of Office Action], 8 pages.
Search Report and Written Opinion, dated Sep. 2, 2022, in connection with Singapore Patent Application No. 11202100023X, 12 pages.
Response, filed Feb. 3, 2023, to Search Report and Written Opinion, dated Sep. 2, 2022, in connection with Singapore Patent Application No. 11202100023X, 22 pages.
Office Action, issued Jun. 29, 2022, in connection with U.S. Appl. No. 16/824,500, 25 pages.
Response, filed Dec. 29, 2022, to Office Action, issued Jun. 29, 2022, in connection with U.S. Appl. No. 16/824,500, 66 pages.
Examiner's Report, dated Jan. 3, 2023, in connection with Canadian Patent Application No. 3,131,017 [D1=Xie et al. (2018) Cell Host & Microbe 23:297-301.e4; D2=WO 2019/014398; D3=KR 10-2018-0066296; D4=Xie et al. (2010) Developmental and Comparative Immunology 34(8):847-854; D5=Burdette et al. (2011) Nature 478(7370):515-518; D6=WO 2017/156349; D7=Jieun et al. (2016) J. Allergy Clin. Immunol. 139(4): 1396-1399.e12; D8-Conlon et al. (2013) J. Immunol. 190(10):5216-5225; D9=de Oliveira Mann et al. (2019) Cell Reports 27(4):1165-1175.e5; D10=Patel et al. (2018) Genes and Immunity 20(1):82-89], 8 pages.
Examiner's Report, dated Nov. 25, 2022, in connection with Canadian Patent Application No. 3,176,660, 5 pages.
Examiner's Report, dated Dec. 21, 2022, in connection with Canadian Patent Application No. 3,161,450, 7 pages.
Letter/Written Disclosure of the Information Disclosure Statement for the above-referenced application, filed herewith Apr. 7, 2022, 2 pages.
Ablasser et al., "Cell intrinsic immunity spreads to bystander cells via the intercellular transfer of cGAMP," Nature 503(7477):530-534 (2013).
Agbor, T. A. and McCormick, B. A., "*Salmonella* Effectors: Important players modulating host cell function during infection," Cell Microbiol. 13(12):1858-1869 (2011).
Ahn et al., "A hydrocarbon ruler measures palmitate in the enzymatic acylation of endotoxin," EMBO J. 23:2931-2941 (2004).
Ahn et al., "Intrinsic Self-DNA Triggers Inflammatory Disease Dependent on STING," J. Immunol. 193(9):4634-4642 (2014).
Ahn et al., "Extrinsic Phagocyte-Dependent STING Signaling Dictates the Immunogenicity of Dying Cells," Cancer Cell 33(5):862-873 (2018).
Akira et al., "Toll-like receptors: critical proteins linking innate and acquired immunity," Nat. Immunol. 2(8):675-680 (2001).
Aleksic et al., "Different affinity windows for virus and cancer-specific T-cell receptors—implications for therapeutic strategies," Eur. J. Immunol. 42(12):3174-3179 (2012).
Allen et al., "CCL3 augments tumor rejection and enhances $CD8^+T$ cell infiltration through NK and $CD103^+$dendritic cell recruitment via IFNγ," Oncoimmunology 7(3):e1393598 (2018).
Anassi, E. and Ndefo, U. A., "Sipuleucel-T (Provenge) Injection The First Immunotherapy Agent (Vaccine) For Hormone-Refractory Prostate Cancer," P&T 36(4):197-202 (2011).
Angelakopoulos, H. and Hohmann, E. L., "Pilot Study of phoP/phoQ-Deleted *Salmonella enterica* Serovar Typhimurium Expressing *Helicobacter pylori* Urease in Adult Volunteers," Infection and Immunity 68(4):2135-2141 (2000).
Angelova et al., "The Oncolytic Virotherapy Era in Cancer Management: Prospects of Applying H-1 Parvovirus to Treat Blood and Solid Cancers," Front. Oncol. 7:93 (2017), 8 pages.
Angelova et al., "Tumor selectivity of oncolytic parvoviruses: from in vitro and animal models to cancer patients," Frontiers in Bioengineering and Biotechnology 3:55 (2015), 14 pages.
Ansel H. C., "Introduction to Pharmaceutical Dosage Forms," Fourth Edition, 1985, p. 126.
Antonioli et al., "Immunity, inflammation and cancer: a leading role for adenosine," Nat. Rev. Cancer 13(12):842-857 (2013).
Anwar et al., "Modulation of Biofilm-Formation in *Salmonella enterica* Serovar Typhimurium by the Periplasmic DsbA/DsbB Oxidoreductase System Requires the GGDEF-EAL Domain Protein STM3615," PLoS ONE 9(8):e106095 (2014), 12 pages.
Aref et al., "Measles to the Rescue: A Review of Oncolytic Measles Virus," Viruses 8:294 (2016), 16 pages.
Argyle, D. and Kitamura, T., "Targeting Macrophage-Recruiting Chemokines as a Novel Therapeutic Strategy to Prevent the Progression of Solid Tumors," Front. Immunol. 9:2629 (2018), 15 pages.
Arpaia ct al., "TLR signaling is required for virulence of an intracellular pathogen," Cell 144(5):675-688 (2011).
ATCC Product Sheet, "*Salmonella typhimurium* YS1646 (202165)," 2 pages (2018).
Augustin et al., "*Salmonella enterica* Typhimurium Engineered for Nontoxic Systemic Colonization of Autochthonous Tumors," Journal of Drug Targeting 29(3):294-299 (2021), 21 pages.
Avogardi et al., "Cancer Immunotherapy Based on Killing of *Salmonella*-Infected Tumor Cells," Cancer Res 65(9): 3920-3927 (2005).
Baban et al., "Bacteria as vectors for gene therapy of cancer," Bioengineered Bugs 1(6):385-394 (2010).
Babinski et al., "Accumulation of the Lipid A Precursor UDP-2,3-diacylglucosamine in an *Escherichia coli* Mutant Lacking the lpxH Gene," J. Biol. Chem. 277(29):25947-25956 (2002).
Babinski et al., "The *Escherichia coli* Gene Encoding UDP-2,3-diacylglucosamine Pyrophosphatase of Lipid A Biosynthesis," J. Biol. Chem. 277(29):25937-25946 (2002).
Bainbridge et al., "Acyl Chain Specificity of the Acyltransferases LpxA and LpxD and Substrate Availability Contribute to Lipid A Fatty Acid Heterogeneity in *Porphyromonas gingivalis*," Journal of Bacteriology 190(13):4549-4558 (2008).
Barb et al., "Structure of the deacetylase LpxC bound to the antibiotic CHIR-090: Time-dependent inhibition and specificity in ligand binding," Proc. Natl. Acad. Sci. U.S.A. 104(47):18433-18438 (2007).
Barber, G. N., "Cytoplasmic DNA innate immune pathways," Immunol. Rev. 243(1):99-108 (2011).
Barber, G. N., "STING: infection, inflammation and cancer," Nat. Rev. Immunol. 15(12):760-770 (2015).
Baroudy et al., "Incompletely base-paired flip-flop terminal loops link the two DNA strands of the vaccinia virus genome into one uninterrupted polynucleotide chain," Cell 28(2):315-324 (1982).
Bartling et al., "Crystal Structure and Acyl Chain Selectivity of *Escherichia coli* LpxD, the N-Acyltransferase of Lipid A Biosynthesis," Biochemistry 48(36):8672-8683 (2009).
Bastin et al., "Capitalizing on Cancer Specific Replication: Oncolytic Viruses as a Versatile Platform for the Enhancement of Cancer Immunotherapy Strategies," Biomedicines 4(3):21 (2016), 19 pages.
Basu et al., "Expression Cloning and Characterization of the C28 Acyltransferase of Lipid A Biosynthesis in *Rhizobium leguminosarum*," J. Biol. Chem. 277(32):28959-28971 (2002).
Bermudes et al., "Tumour-Selective *Salmonella*-Based Cancer Therapy," Biotechnology and Genetic Engincering Reviews 18(1):219-233 (2001).
Bermudes et al., "Tumor-Targeted *Salmonella* Highly Selective Delivery Vectors," Cancer Gene Therapy: Past Achievements and Future Challenges, ed. Habib, Kluwer Academic/Plenum Publishers, New York, Chp. 6, pp. 57-63 (2000).
Bermudes et al., "Live bacteria as anticancer agents and tumor-selective protein delivery vectors," Curr. Opin. Drug Discov. Devel. 5(2):194-199 (2002).

(56) References Cited

OTHER PUBLICATIONS

Binder et al., "Antigen-Specific Bacterial Vaccine Combined with Anti-PD-L1 Rescues Dysfunctional Endogenous T Cells to Reject Long-Established Cancer," Cancer Immunol. Res. 1(2):123-133 (2013).
Bishnoi et al., "Oncotargeting by Vesicular Stomatitis Virus (VSV): Advances in Cancer Therapy," Viruses 10(2):90 (2018), 20 pages.
Blache et al., "Systemic Delivery of *Salmonella typhimurium* Transformed with IDO shRNA Enhances Intratumoral Vector Colonization and Suppresses Tumor Growth," Cancer Res. 72(24):6447-6456 (2012).
Bos et al., "Identification of an outer membrane protein required for the transport of lipopolysaccharide to the bacterial cell surface," Proc. Natl. Acad. Sci. U.S.A. 101(25):9417-9422 (2004).
Bouis et al., "Severe combined immunodeficiency in stimulator of interferon genes (STING) V154M/wild-type mice," J. Allergy Clin. Immunol. 143(2):712-725.e5 (2019).
Bowyer et al., "Characterization of interactions between LPS transport proteins of the Lpt system," Biochem. Biophys. Res. Commun. 404:1093-1098 (2011).
Bradley et al., "Applications of coxsackievirus A21 in oncology," Oncolytic Virotherapy 3:47-55 (2014).
Broadway ct al., "Complete genome sequence of *Salmonella enterica* scrovar Typhimurium VNP20009, a strain engineered for tumor targeting," Journal of Biotechnology 192:177-178 (2014).
Broadway et al., "Rescuing chemotaxis of the anticancer agent *Salmonella enterica* serovar Typhimurium VNP20009," Journal of Biotechnology 211:117-120 (2015).
Broder, C. C. and Earl, P. L., "Recombinant vaccinia viruses. Design, generation, and isolation," Mol. Biotechnol. 13(3):223-245 (1999).
Broz, P. and Monack, D. M., "Molecular Mechanisms of Inflammasome Activation during Microbial Infections," Immunol. Rev. 243(1):174-190 (2011).
Brozek, K. A. and Raetz, C. R. H., "Biosynthesis of Lipid A in *Escherichia coli*," J. Biol. Chem. 265(26):15410-15417 (1990).
Brozek et al., "Biosynthesis of Lipopolysaccharide in *Escherichia coli*," J. Biol. Chem. 264(12):6956-6966 (1989).
Bucarey et al., "The *Salmonella enterica* Serovar Typhi tsx Gene, Encoding a Nucleoside-Specific Porin, Is Essential for Prototrophic Growth in the Absence of Nucleosides," Infection and Immunity 73(10):6210-6219 (2005).
Buchbinder, E. and Hodi, F. S., "Cytotoxic T lymphocyte antigen-4 and immune checkpoint blockade," J. Clin. Invest. 125(9):3377-3383 (2015).
Buetow et al., "Structure and reactivity of LpxD, the N-acyltransferase of lipid A biosynthesis," Proc. Natl. Acad. Sci. U.S.A. 104(11):4321-4326 (2007).
Burdette et al., "STING is a direct innate immune sensor of cyclic-di-GMP," Nature 478(7370):515-518 (2011).
Burke, M. J., "Oncolytic Seneca Valley Virus: past perspectives and future directions," Oncolytic Virotherapy 5:81-89 (2016).
Burke et al., "Phase I Trial of Seneca Valley Virus (NTX-010) in Children with Relapsed/Refractory Solid Tumors: A Report of the Children's Oncology Group," Pediatr. Blood Cancer 62(5):743-750 (2015).
Bursztejn et al., "Unusual cutaneous features associated with a heterozygous gain-of-function mutation in IFIH1: overlap between Aicardi-Goutières and Singleton-Merten syndromes," Br. J. Dermatol. 173(6):1505-1513 (2015).
Cai et al., "Identification of Three Genes Encoding for the Late Acyltransferases of Lipid A in *Cronobacter sakazakii*," Mar. Drugs 11:377-386 (2013).
Camacho et al., "Engineering *Salmonella* as intracellular factory for effective killing of tumour cells," Sci Rep 6(30591): 1-12 (2016).
Carina et al., "Modular Architecture of the STING C-Terminal Tail Allows Interferon and NF-κB Signaling Adaptation," Cell Rep 27(4): 1165-1175.e5 (2019).
Carrillo, H. and Lipman, D., "The multiple sequence alignment problem in biology," SIAM J. Applied Math 48(5): 1073-1082 (1988).
Carroll, V. A. and Ashcroft, M., "Targeting the molecular basis for tumour hypoxia," Expert Rev. Mol. Med. 7(6):1-16 (2005).
Caskey et al., "Synthetic double-stranded RNA induces innate immune responses similar to a live viral vaccine in humans," J. Exp. Med. 208(12):2357-2366 (2011).
Castle et al., "Immunomic, genomic and transcriptomic characterization of CT26 colorectal carcinoma," BMC Genomics 15(1):190 (2014), 12 pages.
Chang et al., "Creating an miR30-Based shRNA Vector," Cold Spring Harb. Protoc., doi:10.1101/pdb.prot075853, pp. 631-635 (2013).
Chatfield et al., "Use of the nirB promoter to direct the stable expression of heterologous antigens in *Salmonella* oral vaccine strains: development of a single-dose oral tetanus vaccine," Biotechnology 10(8):888-892 (1992).
Chen et al., "Developing Effective Salmonella-based Approaches to Treat Pancreatic Cancer," Pancreat Disord. Ther. 6(1): 1-2 (2016).
Chen et al., "Proteomic Screening of Anaerobically Regulated Promoters from *Salmonella* and Its Antitumor Applications," Mol. Cell. Proteomics 10(6):M111.009399 (2011), 11 pages.
Chen et al., "The Neutrophil NLRC4 Inflammasome Selectively Promotes IL-1β Maturation without Pyroptosis during Acute *Salmonella* Challenge," Cell Reports 8:570-582 (2014).
Chen, L. and Han, X., "Anti-PD-1/PD-L1 therapy of human cancer: past, present and future," J. Clin. Invest. 125(9):3384-3391 (2015).
Cheng et al., "Genetic Modification of Oncolytic Newcastle Disease Virus for Cancer Therapy," J. Virol. 90(1):5343-5352 (2016).
Chi et al., "Anti-tumor Activity of Toll-Like Receptor 7 Agonists," Frontiers in Pharmacology 8:304 (2017).
Chimalakonda et al., "Lipoprotein LptE is required for the assembly of LptD by the β-barrel assembly machine in the outer membrane of *Escherichia coli*," Proc. Natl. Acad. Sci. U.S.A. 108(6):2492-2497 (2011).
Chiocca, E. A. and Rabkin, S. D., "Oncolytic Viruses and Their Application to Cancer Immunotherapy," Cancer Immunol. Res. 2(4):295-300 (2014).
Chiu et al., "RNA polymerase III detects cytosolic DNA and induces type-I interferons through the RIG-I pathway," Cell 138(3):576-591 (2009).
Chng et al., "Disulfide Rearrangement Triggered by Translocon Assembly Controls Lipopolysaccharide Export," Science 337(6102):1665-1668 (2012).
Choi et al., "Polymeric oncolytic adenovirus for cancer gene therapy," J. Control. Release 219:181-191 (2015).
Chorobik et al., "*Salmonella* and cancer: from pathogens to therapeutics," Acta Biochimica Polonica 60(3):285-297 (2013).
Civril et al., "Structural mechanism of cytosolic DNA sensing by cGAS," Nature 498(7454):332-337 (2013).
Clairmont ct al., "Biodistribution and Genetic Stability of the Novel Antitumor Agent VNP20009, a Genetically Modified Strain of *Salmonella typhimurium*," Journal of Infectious Diseases 181:1996-2002 (2000).
Coburn et al., "Type III Secretion Systems and Disease," Clinical Microbiology Reviews 20(4):535-549 (2007).
Conlon et al., "Mouse, but not human STING, Binds and Signals in Response to the Vascular Disrupting Agent 5,6-Dimethylxanthenone-4-Acetic Acid," J. Immunol. 190(10):5216-5225 (2013), 19 pages.
Copier, J. and Dalgleish, A.,"Whole-cell vaccines: A failure or a success waiting to happen?" Curr. Opin. Mol. Ther. 12(1):14-20 (2010) [abstract].
Corbett et al., "Tumor Induction Relationships in Development of Transplantable Cancers of the Colon in Mice for Chemotherapy Assays, with a Note on Carcinogen Structure," Cancer Res. 35(9):2434-2439 (1975).
Corrales et al., "Direct activation of STING in the tumor microenvironment leads to potent and systemic tumor regression and immunity," Cell Rep. 11(7):1018-1030 (2015).
Crowell et al., "Molecular Cloning of the Genes for Lipid A Disaccharide Synthase and UDP-N-Acetylglucosamine Acyltransferase in *Esherichia coli*," Journal of Bacteriology 168(1):152-159 (1986).

(56) References Cited

OTHER PUBLICATIONS

Crowell et al., "Nucleotide Sequence of the *Escherichia coli* Gene for Lipid A Disaccharide Synthase," Journal of Bacteriology 169(12):5727-5734 (1987).
Crull et al., "Biofilm formation by *Salmonella enterica* serovar Typhimurium colonizing solid tumours," Cellular Microbiology 13(8):1223-1233 (2011).
Dang et al., "Combination bacteriolytic therapy for the treatment of experimental tumors," Proc. Natl. Acad. Sci. U.S.A. 98(26):15155-15160 (2001).
Datsenko, K. A. and Wanner, B. L., "One-step inactivation of chromosomal genes in *Escherichia coli* K-12 using PCR products," Proc. Natl. Acad. Sci. U.S.A. 97(12):6640-6645 (2000).
De Oliveira Mann et al., "Modular Architecture of the STING C-Terminal Tail Allows Interferon and NF-κB Signaling Adaptation," Cell Reports 27:1165-1175 (2019) [with Supplementary Information], 26 pages.
Dean et al., "Sequence requirements for plasmid nuclear import," Exp. Cell Res. 253(2):713-722 (1999).
Del Solar et al., "Replication and Control of Circular Bacterial Plasmids," Microbiology and Molecular Biology Reviews 62(2):434-464 (1998).
Diamond et al., "Type I interferon is selectively required by dendritic cells for immune rejection of tumors," J. Exp. Med. 208(10):1989-2003 (2011).
Dinarello, C. A., "Proinflammatory and Anti-inflammatory Cytokines as Mediators in the Pathogenesis of Septic Shock," Chest 112(6 Suppl):321S-329S (1997).
Diner et al., "The innate immune DNA sensor cGAS produces a non-canonical cyclic-di-nucleotide that activates human STING," Cell Rep. 3(5):1355-1361 (2013).
DiPctrillo ct al., "Safety and immunogenicity of phoP/phoQ-deleted *Salmonella typhi* expressing *Helicobacter pylori* urease in adult volunteers," Vaccine 18(5-6):449-459 (2000).
Di Domenico et al., "Biofilm Producing *Salmonella* Typhi: Chronic Colonization and Development of Gallbladder Cancer," Int. J. Mol. Sci. 18:1887 (2017), 14 pages.
Dold et al., "Application of interferon modulators to overcome partial resistance of human ovarian cancers to VSV-GP oncolytic viral therapy," Molecular Therapy—Oncolytics 3:16021 (2016), 11 pages.
Dotti et al., "Transgenic expression of CD40 ligand produces an in vivo antitumor immune response against both $CD40^+$and $CD40^+$ plasmacytoma cells," Blood 100(1):200-207 (2002).
Dreher et al., "Genetic background of attenuated *Salmonella typhimurium* has profound influence on infection and cytokine patterns in human dendritic cells," J. Leukoc. Biol. 69:583-589 (2001).
Dubinett et al., "Chemokines: Can Effector Cells be Re-directed to the Site of Tumor?" Cancer J. 16(4):325-335 (2010).
Durfee et al., "The complete genome sequence of *Escherichia coli* DH10B: insights into the biology of a laboratory workhorse," J. Bacteriol. 190(7):2597-2606 (2008).
Eisenstark et al., "Development of *Salmonella* Strains as Cancer Therapy Agents and Testing in Tumor Cell Lines," Methods in Molecular Biology 394:323-354 (2007).
Eissa et al., "Genomic Signature of the Natural Oncolytic Herpes Simplex Virus HF10 and Its Therapeutic Role in Preclinical and Clinical Trials," Front. Oncol. 7:149 (2017), 12 pages.
Emptage et al., "Crystal structure of LpxK, the 4'-kinase of lipid A biosynthesis and atypical P-loop kinase functioning at the membrane interface," Proc. Natl. Acad. Sci. U.S.A. 109(32):12956-12961 (2012).
Ergun et al., "STING Polymer Structure Reveals Mechanisms for Activation, Hyperactivation, and Inhibition," Cell 178(2):290-301 (2019).
Esteves et al., "Combination of Interleukin-15 With a STING Agonist, ADU-S100 Analog: A Potential Immunotherapy for Prostate Cancer," Front. Oncol. 11:621550 (2021), 15 pages.
Fabbi et al., "Context-dependent role of IL-18 in cancer biology and counter-regulation by IL-18BP," J. Leukoc. Biol. 97:665-675 (2015).
Faulds-Pain et al., "Flagellin Redundancy in Caulobacter crescentus and its Implications for Flagellar Filament Assembly," Journal of Bacteriology 193(11):2695-2707 (2011).
Felgner et al., "aroA-Deficient *Salmonella enterica* Serovar Typhimurium Is More Than a Metabolically Attenuated Mutant," mBio 7(5):e01220-16 (2016), 12 pages.
Felgner et al., "Optimizing *Salmonella enterica* serovar Typhimurium for bacteria-mediated tumor therapy," Gut Microbes 7(2):171-177 (2016).
Felgner et al., "Engineered *Salmonella enterica* serovar Typhimurium overcomes limitations of anti-bacterial immunity in bacteria-mediated tumor therapy," Oncoimmunology 7(2):e1382791 (2018), 12 pages.
Felgner et al., "Tumor-targeting bacteria-based cancer therapies for increased specificity and improved outcome," Microbial Biotechnology 10(5):1074-1078 (2017).
Felt, S. A. and Grdzelishvili, V. Z., "Recent advances in vesicular stomatitis virus-based oncolytic virotherapy: a 5-year update, " Journal of General Virology 98:2895-2911 (2017).
Fields et al., "Mutants of *Salmonella typhimurium* that cannot survive within the macrophage are avirulent," Proc. Natl. Acad. Sci. U.S.A. 83:5189-5193 (1986).
Figueira, R. and Holden, D. W., "Functions of the *Salmonella* pathogenicity island 2 (SPI-2) type III secretion system effectors," Microbiology 158:1147-1161 (2012).
Fink, S. L. and Cookson, B. T., "Pyroptosis and host cell death responses during *Salmonella* infection," Cellular Microbiology 9(11):2562-2570 (2007).
Frahm et al., "Efficiency of Conditionally Attenuated *Salmonella enterica* Serovar Typhimurium in Bacterium-Mediated Tumor Therapy," mBio 6(2):e00254-15 (2015), 11 pages.
Freeman et al., "Phase I/II Trial of Intravenous NDV-HUJ Oncolytic Virus in Recurrent Glioblastoma Multiforme," Mol. Ther. 13(1):221-228 (2006).
Freinkman et al., "The complex that inserts lipopolysaccharide into the bacterial outer membrane forms a two-protein plug-and-barrel," Proc. Natl. Acad. Sci. U.S.A. 108(6):2486-2491 (2011).
Fu et al., "Effective Treatment of Pancreatic Cancer Xenografts with a Conditionally Replicating Virus Derived from Type 2 Herpes Simplex Virus," Clin. Cancer Res. 12(10):3152-3157 (2006).
Fuertes et al., "Host type I 1FN signals are required for antitumor $CD8^+$T cell responses through $CD8\alpha^+$dendritic cells," J. Exp. Med. 208(10):2005-2016 (2011).
Galan, J. E. and Curtiss, R. III., "Virulence and vaccine potential of phoP mutants of *Salmonella typhimurium*," Microb. Pathog. 6(6):433-443 (1989).
Galan, J. E. and Wolf-Watz, H., "Protein delivery into eukaryotic cells by type III secretion machines, " Nature 444:567-573 (2006).
Galan et al., "Cloning and characterization of the asd gene of *Salmonella typhimurium*: use in stable maintenance of recombinant plasmids in *Salmonella* vaccine strains," Gene 94(1):29-35 (1990).
Gao et al., "Binding-Pocket and Lid-Region Substitutions Render Human STING Sensitive to the Species-Specific Drug DMXAA," Cell Reports 8(6):1668-1676 (2014).
Gao ct al., "Integrative Analysis of Complex Cancer Genomics and Clinical Profiles Using the cBioPortal," Sci. Signal. 6(269):pl1 (2013), 34 pages.
Gardlik et al., "Gene therapy for cancer: bacteria-mediated anti-angiogenesis therapy," Gene Therapy 18:425-431 (2011).
Garrett et al., "Accumulation of a Lipid A Precursor Lacking the 4'-Phosphate following Inactivation of the *Escherichia coli* lpxK Gene," J. Biol. Chem. 273(20):12457-12465 (1998).
Garrett et al., "Identification of the Gene Encoding the *Escherichia coli* Lipid A 4'-Kinase," J. Biol. Chem. 272(35):21855-21864 (1997).
Geiss et al., "Preclinical Testing of an Oncolytic Parvovirus: Standard Protoparvovirus H-1PV Efficiently Induces Osteosarcoma Cell Lysis in Vitro," Viruses 9:301 (2017), 18 pages.
Geletneky et al., "Oncolytic H-1 Parvovirus Shows Safety and Signs of Immunogenic Activity in a First Phase I/IIa Glioblastoma Trial," Mol. Ther. 25(12):2620-2634 (2017).

(56) References Cited

OTHER PUBLICATIONS

Ginting et al., "Proinflammatory response induced by Newcastle disease virus in tumor and normal cells," Oncolytic Virotherapy 6:21-30 (2017).
Gong et al., "Clinical development of reovirus for cancer therapy: An oncolytic virus with immune-mediated antitumor activity," World J. Methodol. 6(1):25-42 (2016).
Gribskov, M. and Burgess, R. R., "Sigma factors from *E. coli, B. subtilis*, phage SP01, and phage T4 are homologous proteins," Nucl. Acids Res. 14(16):6745-6763 (1986).
Groisman et al., "*Salmonella typhimurium* phoP virulence gene is a transcriptional regulator," Proc. Natl. Acad. Sci. U.S.A. 86:7077-7081 (1989).
Guo et al., "Targeting tumor gene by shRNA-expressing *Salmonella*-mediated RNAi," Gene Therapy 18:95-105 (2011).
Hagar et al., "WildCARDs: Inflammatory caspases directly detect LPS," Cell Research 25:149-150 (2015).
Halama et al., "Tumoral Immune Cell Exploitation in Colorectal Cancer Metastases Can Be Targeted Effectively by Anti-CCR5 Therapy in Cancer Patients," Cancer Cell 29(4):587-601 (2016).
Han et al., "IL-15:IL-15 receptor alpha superagonist complex: High-level co-expression in recombinant mammalian cells, purification and characterization," Cytokine 56(3):804-810 (2011).
Harrington et al., "Preliminary results of the first-in-human (FIH) study of MK-1454, an agonist of stimulator of interferon genes (STING), as monotherapy or in combination with pembrolizumab (pembro) in patients with advanced solid tumors or lymphomas," EMSO 2018 Congress, Abstract #5475 (2018), 1 page.
Heath, R. J. and Rock, C. O., "Roles of the FabA and FabZ β-Hydroxyacyl-Acyl Carrier Protein Dehydratases in *Escherichia coli* Fatty Acid Biosynthesis," J. Biol. Chem. 271(44):27795-27801 (1996).
Heimann, D. M. and Rosenberg, S. A., "Continuous Intravenous Administration of Live Genetically Modified *Salmonella typhimurium* in Patients With Metastatic Melanoma," J. Immunother. 26(2):179-180 (2003).
Heo et al., "Sequential Therapy With JX-594, A Targeted Oncolytic Poxvirus, Followed by Sorafenib in Hepatocellular Carcinoma: Preclinical and Clinical Demonstration of Combination Efficacy," Mol. Ther. 19(6):1170-1179 (2011).
Hervas-Stubbs et al., "Conventional but not plasmacytoid dendritic cells foster the systemic virus-induced type I IFN response needed for efficient CD8 T cell priming," J. Immunol. 193(3):1151-1161 (2014).
Hodi et al., "Improved Survival with Ipilimumab in Patients with Metastatic Melanoma," N. Engl. J. Med. 363(8):711-723 (2010).
Hohmann et al., "phoP/phoQ-Deleted *Salmonella typhi* (Ty800) Is a Safe and Immunogenic Single-Dose Typhoid Fever Vaccine in Volunteers," J. Infect. Dis. 173:1408-1414 (1996).
Hu et al., "Differential outcome of TRIF-mediated signaling in TLR4 and TLR3 induced DC maturation," Proc. Natl. Acad. Sci. U.S.A. 112(45):13994-13999 (2015).
Huang, X. and Miller, W., "A Time-Efficient, Linear-Space Local Similarity Algorithm," Adv. Appl. Math. 12(3):337-357 (1991).
Husseiny, M. I. and Hensel, M., "Rapid method for the construction of *Salmonella enterica* Serovar Typhimurium vaccine carrier strains," Infect. Immun. 73(3):1598-1605 (2005).
Hutzen et al., "Advances in the design and development of oncolytic measles viruses," Oncolytic Virotherapy 4:109-118 (2015).
Ireton, R. C. and Gale, M. Jr., "RIG-I Like Receptors in Antiviral Immunity and Therapeutic Applications," Viruses 3:906-919 (2011).
Ittig et al., "A bacterial type III secretion-based protein delivery tool for broad applications in cell biology," J. Cell Biol. 211(4):913-931 (2015).
IUPAC-IUB Commission on Biochemical Nomenclature, "A One-Letter Notation for Amino Acid Sequences: Tentative Rules," The Journal of Biological Chemistry 243(13):3557-3559 (1968).
IUPAC-IUB Commission on Biochemical Nomenclature, "Symbols for Amino-Acid Derivatives and Peptides: Recommendations (1971)," Biochem. 11(9):1726-1732 (1972).
Ivashkiv, L. B. and Donlin, L. T., "Regulation of type I interferon responses," Nat. Rev. Immunol. 14(1):36-49 (2014).
Iwasaki, A. and Medzhitov, R., "Regulation of adaptive immunity by the innate immune system," Science 327(5963):291-295 (2010).
Jackson et al., "Driving CAR T-cells forward," Nat. Rev. Clin. Oncol. 13(6):370-383 (2016).
Jacobson et al., "Cap-dependent translational control of oncolytic measles virus infection in malignant mesothelioma," Oncotarget 8(38):63096-63109 (2017).
Jang et al., "Mutations in DDX58, which Encodes RIG-I, Cause Atypical Singleton-Merten Syndrome," Am. J. Hum. Genet. 96:266-274 (2015).
Jiang et al., "Oncolytic adenovirus research evolution: from cell-cycle checkpoints to immune checkpoints," Curr. Opin. Virol. 13:33-39 (2015).
Jieun et al., "Tofacitinib relieves symptoms of stimulator of interferon genes (STING)-associated vasculopathy with onset in infancy caused by 2 de novo variants in TMEM173," *J. Allergy Clin. Immunol.* 139(4):1396-1399.c12 (2016).
Kakarla, S. and Gottschalk, S., "CAR T cells for solid tumors: armed and ready to go?" Cancer J. 20(2):151-155 (2014).
Kalinski et al., "Prostaglandin E2 is a selective inducer of interleukin-12 p40 (IL-12p40) production and an inhibitor of bioactive IL-12p70 heterodimer," Blood 97:3466-3469 (2001).
Kalliolias, G. D. and Ivashkiv, L. B., "Overview of the biology of type I interferons," Arthritis Research & Therapy 12(Suppl 1):S1 (2010), 9 pages.
Kang et al., "Preventative and therapeutic effects of auxotrophic *Edwardsiella tarda* mutant harboring CpG 1668 motif-enriched plasmids against scuticociliatosis in olive flounder (*Paralichthys olivaceus*)," Experimental Parasitology 144:34-38 (2014).
Kasinskas, R. W. and Forbes, N. S., "*Salmonella typhimurium* lacking ribose chemoreceptors localize in tumor quiescence and induce apoptosis," Cancer Res. 67(7):3201-3209 (2007).
Kawaguchi et al., "High-efficacy targeting of colon-cancer liver metastasis with *Salmonella typhimurium* A1-R via intra-portal-vein injection in orthotopic nude-mouse models," Oncotarget 8(12):19065-19073 (2017).
Kawai, T. and Akira, S., "Pathogen recognition with Toll-like receptors," Curr. Opin. Immunol. 17(4):338-344 (2005).
Kelly et al., "Novel Oncolytic Agent GLV-1h68 Is Effective Against Malignant Pleural Mesothelioma, " Hum. Gene Ther. 19:774-782 (2008).
Kemp et al., "Exploring Reovirus Plasticity for Improving Its Use as Oncolytic Virus," Viruses 8, 4 (2016), 16 pages.
Keskitalo et al., "Characterization of novel TMEM173 mutation with additive IFIH1 risk allele," bioRxiv, available from: doi.org/10.1101/394353 (2018), 30 pages.
Khan et al., "A lethal role for lipid A in *Salmonella* infections," Mol. Microbiol. 29(2):571-579 (1998).
Kim et al., "Overview analysis of adjuvant therapies for melanoma—a special reference to results from vaccinia melanoma oncolysate adjuvant therapy trials," Surgical Oncol. 10(1-2):53-59 (2001).
Kimbrough, T. G. and Miller, S. I., "Assembly of the type III secretion needle complex of *Salmonella typhimurium*," Microbes Infect. 4(1):75-82 (2002).
Kimpel et al., "The Oncolytic Virus VSV-GP Is Effective against Malignant Melanoma," Viruses 10, 108 (2018), 16 pages.
Kimura et al., "Selective Localization and Growth of *Bifidobacterium bifidum* in Mouse Tumors following Intravenous Administration," Cancer Res. 40:2061-2068 (1980).
Kistner et al., "Interferon-inducible CXC-chemokines are crucial immune modulators and survival predictors in colorectal cancer," Oncotarget 8(52):89998-90012 (2017).
Klein et al., "*Escherichia coli* K-12 Suppressor-free Mutants Lacking Early Glycosyltransferases and Late Acyltransferases," J. Biol. Chem. 284(23):15369-15389 (2009).
Kocijancic et al., "Local application of bacteria improves safety of *Salmonella*-mediated tumor therapy and retains advantages of systemic infection," Oncotarget 8(30):49988-50001 (2017).

(56) References Cited

OTHER PUBLICATIONS

Kohlhapp, F. J. and Kaufman, H. L., "Molecular Pathways: Mechanism of Action for Talimogene Laherparepvec, a New Oncolytic Virus Immunotherapy," Clin. Cancer Res. 22(5):1048-1054 (2016).
Kong et al., "Turning self-destructing *Salmonella* into a universal DNA vaccine delivery platform," Proc. Natl. Acad. Sci. U.S.A. 109(47):19414-19419 (2012).
Kong et al., "Palmitoylation State Impacts Induction of Innate and Acquired Immunity by the *Salmonella enterica* Serovar Typhimurium msbB Mutant," Infection and Immunity 79(12):5027-5038 (2011).
Konno et al., "Pro-inflammation Associated with a Gain-of-Function Mutation (R284S) in the Innate Immune Sensor STING," Cell Reports 23:1112-1123 (2018).
Koopman et al., "Inhibition of *Salmonella enterica* Biofilm Formation Using Small-Molecule Adenosine Mimetics," Antimicrobial Agents and Chemotherapy 59(1):76-84 (2015).
Kortmann et al., "Cutting Edge: Inflammasome Activation in Primary Human Macrophages is Dependent on Flagellin," J. Immunol. 195:815-819 (2015).
Kresge et al., "The Lipid A Assembly Pathway: The Work of Christian Raetz," J. Biol. Chem. 286(29):e6-e8 (2011).
Kuo et al., "The Role of CXCR3 and Its Chemokine Ligands in Skin Disease and Cancer," Front. Med. (Lausanne) 5:271 (2018), 10 pages.
Kzhyshkowska et al., "Stabilin-1, a homeostatic scavenger receptor with multiple functions," J. Cell Mol. Med. 10(3):635-649 (2006).
Lam et al., "Safety and Clinical Usage of Newcastle Disease Virus in Cancer Therapy," Journal of Biomedicine and Biotechnology, Article ID: 718710 (2011), 14 pages.
Lan et al., "Dnase2a deficiency uncovers lysosomal clearance of damaged nuclear DNA via autophagy," Cell Rep. 9(1):180-192 (2014).
Larocca, C. and Schlom, J., "Viral Vector-based Therapeutic Cancer Vaccines," Cancer J. 17(5):359-371 (2011).
Lauric ct al., "A Phase 1 Clinical Study of Intravenous Administration of PV701, an Oncolytic Virus, Using Two-Step Desensitization," Clin. Cancer Res. 12(8):2555-2562 (2006).
Le et al., "A Live-attenuated Listeria Vaccine (ANZ-100) and a Live-attenuated Listeria Vaccine Expressing Mesothelin (CRS-207) for Advanced Cancers: Phase 1 Studies of Safety and Immune Induction," Clin. Cancer Res. 18(3):858-868 (2012).
Le et al., "Safety and Survival With GVAX Pancreas Prime and Listeria Monocytogenes-Expressing Mesothelin (CRS-207) Boost Vaccines for Metastatic Pancreatic Cancer," J. Clin. Oncol. 33(12):1325-1333 (2015).
Lechner et al., "Chemokines, costimulatory molecules and fusion proteins for the immunotherapy of solid tumors," Immunotherapy 3(11):1317-1340 (2011).
Lcc ct al., "Comparative Evaluation of the Acute Toxic Effects in Monkeys, Pigs and Mice of a Genetically Engineered *Salmonella* Strain (VNP20009) Being Developed as an Antitumor Agent," Int. J. Toxicol. 19:19-25 (2000).
Lee, S. and Margolin, K., "Cytokines in Cancer Immunotherapy," Cancers 3:3856-3893 (2011).
Lcc ct al., "MHC class-I-restricted CD8 T cells play a protective role during primary *Salmonella* infection," Immunol. Lett. 148(2):138-143 (2012).
Leschner et al., "Tumor Invasion of *Salmonella enterica* Serovar Typhimurium Is Accompanied by Strong Hemorrhage Promoted by TNF-α," PLoS ONE 4(8):e6692 (2009), 11 pages.
Leventhal et al., "Immunotherapy with engineered bacteria by targeting the STING pathway for anti-tumor immunity," Nat. Commun. 11(1):2739 (2020), 15 pages.
Li et al., "Coadministration of a Herpes Simplex Virus-2-Based Oncolytic Virus and Cyclophosphamide Produces a Synergistic Antitumor Effect and Enhances Tumor-Specific Immune Responses," Cancer Res. 67:7850-7855 (2007).
Li et al., "Murine Dendritic Cells Modified with CXCL 10 Gene and Tumour Cell Lysate Mediate Potent Antitumour Immune Responses in Mice," Scand. J. Immunol. 65(1):8-13 (2007).
Li et al., "Optimal promoter usage for lentiviral vector-mediated transduction of cultured central nervous system cells," J. Neurosci. Methods 189(1):56-64 (2010).
Li et al., "LPS remodeling is an evolved survival strategy for bacteria," Proc. Natl. Acad. Sci. U.S.A. 109(22):8716-8721 (2012).
Li et al., "Pyroptosis of *Salmonella typhimurium*-infected macrophages was supressed and elimination of intracellular bacteria from macrophages was promoted by blocking QscC," Scientific Reports 6:37447 (2016), 12 pages.
Li et al., "Regulating STING in health and disease," J. Inflamm. 14:11 (2017), 21 pages.
Lightfield et al., "Critical role of Naip5 in inflammasome activation by a conserved C-terminal domain of flagellin," Nat. Immunol. 9(10):1171-1178 (2008).
Lin et al., "Multiple Regulatory Domains Control IRF-7 Activity in Response to Virus Infection," J. Biol. Chem. 275(44):34320-34327 (2000).
Lin et al., "Oncolytic Vaccinia Virotherapy of Anaplastic Thyroid Cancer in Vivo," J. Clin. Endocrinol. Metab. 93:4403-4407 (2008).
Lin et al., "Structural and Functional Analysis of Interferon Regulatory Factor 3: Localization of the Transactivation and Autoinhibitory Domains," Mol. Cell Biol. 19(4):2465-2474 (1999).
Lin et al., "The role of IL-7 in Immunity and Cancer," Anticancer Research 37:963-968 (2017).
Lin et al., "Treatment of anaplastic thyroid carcinoma in vitro with a mutant vaccinia virus," Surgery 142(6):976-983 (2007).
Lin et al., "Virus-Dependent Phosphorylation of the IRF-3 Transcription Factor Regulates Nuclear Translocation, Transactivation Potential, and Proteasome-Mediated Degradation," Mol. Cell Biol. 18(5):2986-2996 (1998).
Liu et al., "Activated STING is a Vascular and Pulmonary Syndrome," N. Engl. J. Med. 371:507-518 (2014).
Liu et al., "Blockage of autophagy pathway enhances *Salmonella* tumor-targeting," Oncotarget 7(16):22873-22882 (2016).
Liu et al., "NF-κB signaling in inflammation," Signal Transduction and Targeted Therapy 2:e17023 (2017), 9 pages.
Liu et al., "Outer membrane vesicles from flagellin-deficient *Salmonella enterica* serovar Typhimurium induce cross-reactive immunity and provide cross-protection against hetcrologous *Salmonella* challenge," Scientific Reports 6:34776 (2016), 13 pages.
Liu et al., "The Targeted Oncolytic Poxvirus JX-594 Demonstrates Antitumoral, Antivascular, and Anti-HBV Activities in Patients with Hepatocellular Carcinoma," Mol. Ther. 16(9):1637-1642 (2008).
Liu et al., "Systematic comparison of 2A peptides for cloning multi-genes in a polycistronic vector," Scientific Reports 7:2193 (2017), 9 pages.
Lo et al., "T cell responses to Gram-negative intracellular bacterial pathogens: a role for CD8+T cells in immunity to *Salmonella* infection and the involvement of MHC class Ib molecules," J. Immunol. 162(9):5398-5406 (1999).
Loeffler et al., "Attenuated *Salmonella* engineered to produce human cytokine LIGHT inhibit tumor growth," Proc. Natl. Acad. Sci. U.S.A. 104(31): 12879-12883 (2007).
Loeffler et al., "IL-18-producing *Salmonella* inhibit tumor growth," Cancer Gene Ther. 15(12):787-794 (2008).
Loeffler et al., "Inhibition of Tumor Growth Using *Salmonella* Expressing Fas Ligand," J. Natl. Cancer. Inst. 100:1113-1116 (2008).
Low et al., "Construction of VNP20009: A Novel, Genetically Stable Antibiotic-Sensitive Strain of Tumor-Targeting *Salmonella* for Parenteral Administration in Humans," Methods in Molecular Medicine, vol. 90, Suicide Gene Therapy: Methods and Reviews (Chp 3), pp. 47-59 (2003).
Low et al., "Lipid A mutant *Salmonella* with suppressed virulence and TNFα induction retain tumor- targeting in vivo," Nature Biotechnology 17:37-41 (1999).
Lu, C. and MacDougall, M., "RIG-I-Like Receptor Signaling in Singleton-Merten Syndrome," Front. Genet. 8:118 (2017), 7 pages.
Lundberg et al., "Growth phase-regulated induction of *Salmonella*-induced macrophage apoptosis correlates with transient expression of SPI-1 genes," J. Bacteriol. 181(11):3433-3437 (1999).
Luo et al., "Antitumor Effect of VNP20009, an Attenuated *Salmonella*, in Murine Tumor Models," Oncology Research 12: 501-508 (2002).

(56) References Cited

OTHER PUBLICATIONS

Ma et al., "Periplasmic orientation of nascent lipid A in the inner membrane of an *Escherichia coli* LptA mutant," Proc. Natl. Acad. Sci. U.S.A. 105(37):13823-13828 (2008).
Machine-generated English language translation of Chinese Patent No. CN 103468626 B, 35 pages.
Machine-generated English language translation of Korean Patent Application Publication No. KR 10-2018-0066296, 11 pages.
Mackenzie et al., "Ribonuclease H2 mutations induce a cGAS/STING-dependent innate immune response," EMBO J. 35(8):831-844 (2016).
Mahoney et al., "Combination cancer immunotherapy and new immunomodulatory targets," Nat. Rev. Drug Discov. 14(8):561-584 (2015).
Manon et al., "Chapter 17: The Different Strategies Used by *Salmonella* to Invade Host Cells," In: *Salmonella*—Distribution, Adaptation, Control Measures and Molecular Technologies, eds. Annous and Gurtler, Rijeka, pp. 339-364 (2012).
Manuel et al., "*Salmonella*-Based Therapy Targeting Indoleamine 2,3-Dioxygenase Coupled with Enzymatic Depletion of Tumor Hyaluronan Induces Complete Regression of Aggressive Pancreatic Tumors," Cancer Immunol. Res. 3(9):1096-1107 (2015).
Manuel et al., "Enhancement of Cancer Vaccine Therapy by Systemic Delivery of a Tumor-Targeting *Salmonella*-Based STAT3 shRNA Suppresses the Growth of Established Melanoma Tumors," Cancer Res. 71(12):4183-4191 (2011).
Mariathasan et al., "TGF-β attenuates tumor response to PD-L1 blockade by contributing to exclusion of T cells, " Nature 554(7693):544-548 (2018).
Marin-Acevedo ct al., "Next generation of immune checkpoint therapy in cancer: new developments and challenges," Journal of Hematology & Oncology 11:39 (2018), 20 pages.
Maroun et al., "Designing and building oncolytic viruses," Future Virol. 12(4):193-213 (2017).
Matvccva ct al., "Oncolysis by paramyxoviruscs: preclinical and clinical studies," Molecular Therapy—Oncolytics 2, 150017 (2015), 14 pages.
McCart et al., "Systemic Cancer Therapy with a Tumor-selective Vaccinia Virus Mutant Lacking Thymidine Kinase and Vaccinia Growth Factor Genes," Cancer Res. 61:8751-8757 (2001).
McKelvey et al., "Cell-specific expression of TLR9 isoforms in inflammation," J. Autoimmun. 36(1):76-86 (2011).
Melki et al., "Disease-associated mutations identify a novel region in human STING necessary for the control of type I interferon signaling," J. Allergy Clin. Immunol. 140(2):543-552.c5 (2017).
Methner et al., "*Salmonella* Enteritidis with double deletion in phoP fliC—A potential live *Salmonella* vaccine candidate with novel characteristics for use in chickens," Vaccine 29:3248-3253 (2011).
Metzger et al., "An Alternative Route for UDP-diacylglucosamine Hydrolysis in Bacterial Lipid A Biosynthesis," Biochemistry 49(31):6715-6726 (2010).
Metzger et al., "LpxI structures reveal how a lipid A precursor is synthesized," Nat. Struct. Mol. Biol. 19(11):1132-1138 (2012).
Miao et al., "Innate immune detection of the type III secretion apparatus through the NLRC4 inflammosome," Proc. Natl. Acad. Sci. U.S.A. 107(7):3076-3080 (2010).
Miles et al., "Anthrax toxin receptor 1 is the cellular receptor for Seneca Valley virus," J. Clin. Invest. 127(8):2957-2967 (2017).
Miller et al., "A two-component regulatory system (phoP phoQ) controls *Salmonella typhimurium* virulence," Proc. Natl. Acad. Sci. U.S.A. 86:5054-5058 (1989).
Moehler et al., "Oncolytic virotherapy as emerging immunotherapeutic modality: potential of parvovirus H-1," Frontiers in Oncology 4:92 (2014), 10 pages.
Mohan et al., "An *Escherichia coli* Gene (FabZ) Encoding (3R)-Hydroxymyristoyl Acyl Carrier Protein Dehydrase," J. Biol. Chem. 269(52):32896-32903 (1994).
Moss, B., "Poxvirus vectors: cytoplasmic expression of transferred genes," Curr. Opin. Genet. Dev. 3(1):86-90 (1993).
Msaouel et al., "Oncolytic Measles Virus Strains as Novel Anticancer Agents," Expert Opin. Biol. Ther. 13(4):483-502 (2013).
Muenchmeier et al., "A Novel CXCL10-Based GPI-Anchored Fusion Protein as Adjuvant in NK-Based Tumor Therapy," PLoS One 8(8):e72749 (2013), 12 pages.
Muik et al., "Re-engineering Vesicular Stomatitis Virus to Abrogate Neurotoxicity, Circumvent Humoral Immunity, and Enhance Oncolytic Potency," Cancer Res. 74(13):3567-3578 (2014).
Murakami ct al., "Tumor-targeting *Salmonella typhimurium* A1-R regresses an osteosarcoma in a patient-derived xenograft model resistant to a molecular-targeting drug," Oncotarget 8(5):8035-8042 (2017).
Murugaiyan et al., "Differential CD40/CD40L Expression Results in Counteracting Antitumor Immune Responses," J. Immunol. 178:2047-2055 (2007).
Needleman, S. B., and Wunsch, C. D., "A General Method Applicable to the Search for Similarities in the Amino Acid Sequence of Two Proteins," J. Mol. Biol. 48:443-453 (1970).
Nemunaitis et al., "Pilot trial of genetically modified, attenuated *Salmonella* expressing the *E. coli* cytosine deaminase gene in refractory cancer patients," Cancer Gene Therapy 10:737-744 (2003).
Oda et al., "Aicardi-Goutières Syndrome Is Caused by IFIH1 Mutations," Am. J. Hum. Genet. 95:121-125 (2014).
Ohlson et al., "Structure and function of SifA indicate that interactions with SKIP, SseJ, and RhoA family GTPases induce endosomal tubulation," Cell Host Microbe 4(5):434-446 (2008).
Olsen et al., "The role of flagella and chemotaxis genes in host pathogen interaction of the host adapted *Salmonella enterica* serovar Dublin compared to the broad host range serovar S. Typhimurium," BMC Microbiology 13:67 (2013), 11 pages.
Opiyo et al., "Evolution of the Kdo$_2$-lipid A biosynthesis in bacteria, " BMC Evolutionary Biology 10:362 (2010), 13 pages.
O'Rourke et al., "A single dose of peripherally infused EGFRvIII-directed CAR T cells mediates antigen loss and induces adaptive resistance in patients with recurrent glioblastoma," Sci. Transl. Med. 9(399):eaaa0984 (2017), 30 pages.
Owen et al., "*Salmonella* Suppresses the TRIF-Dependent Type I Interferon Response in Macrophages," mBio 7(1):e02051-15 (2016).
Palani ct al., "Monocyte Stabilin-1 Suppresses the Activation of Th1 Lymphocytes," J. Immunol. 196(1):115-123 (2016).
Pandey et al., "Microbial Sensing by Toll-Like Receptors and Intracellular Nucleic Acid Sensors," Cold Spring Harb. Perspect. Biol. 7:a016246 (2015), 18 pages.
Park et al., "Analysis of virulence and growth of a purine auxotrophic mutant of *Xanthomonas oryzae* pathovar *oryzae*," FEMS Microbiol. Lett. 276(1):55-59 (2007).
Park et al., "Use of a targeted oncolytic poxvirus, JX-594, in patients with refractory primary or metastatic liver cancer: a phase I trial," Lancet Oncol. 9(6):533-542 (2008).
Patel, S. and Jin, L., "TMEM173 variants and potential importance to human biology and disease," Genes & Immunity 20:82-89 (2019).
Patyar et al., "Bacteria in cancer therapy: a novel experimental strategy," J. Biomed. Sci. 17:21 (2010), 9 pages.
Pawelck et al., "Bacteria as tumour-targeting vectors," Lancet Oncol. 4:548-556 (2003).
Pawelek ct al., "Tumor-targeted *Salmonella* as a Novel Anticancer Vector," Cancer Research 57:4537-4544 (1997).
Pebernard, S. and Iggo, R. D., "Determinants of interferon-stimulated gene induction by RNAi vectors," Differentiation 72(2-3):103-111 (2004).
Peggs et al., "Cancer immunotherapy: co-stimulatory agonists and co-inhibitory antagonists," Clinical and Experimental Immunology 157:9-19 (2009).
Phan et al., "Cancer regression and autoimmunity induced by cytotoxic T lymphocyte-associated antigen 4 blockade in patients with metastatic melanoma," Proc. Natl. Acad. Sci. U.S.A. 100(14):8372-8377 (2003).
Piñero-Lambea et al., "Engineered bacteria as therapeutic agents," Curr. Opin. Biotechnol. 35:94-102 (2015).
Qian et al., "Seneca Valley Virus Suppresses Host Type I Interferon Production by Targeting Adaptor Proteins MAVS, TRIF, and TANK for Cleavage," J. Virol. 91(16):e00823-17 (2017), 17 pages.

(56) References Cited

OTHER PUBLICATIONS

Rabe, B., "Aicardi-Goutieres syndrome: clues from the RNase H2 knock-out mouse," J. Mol. Med. (Berl.) 91(11):1235-1240 (2013).
Raetz, C. R. H. and Whitfield, C., "Lipopolysaccharide endotoxins," Annu. Rev. Biochem. 71:635-700 (2002).
Raetz et al., "Lipid A Modification Systems in Gram-Negative Bacteria," Annu. Rev. Biochem. 76:295-329 (2007).
Ramelot et al., "Structure of a specialized acyl carrier protein essential for lipid A biosynthesis with very long chain fatty acids in open and closed configurations," Biochemistry 51(37):7239-7249 (2012).
Rantakari et al., "Stabilin-1 expression defines a subset of macrophages that mediate tissue homeostasis and prevent fibrosis in chronic liver injury," Proc. Natl. Acad. Sci. U.S.A. 113(33):9298-9303 (2016).
Ribas, A., "Relcasing the Brakes on Cancer Immunotherapy," N. Engl. J. Med. 373(16):1490-1492 (2015).
Rice et al., "Gain-of-function mutations in IFIH1 cause a spectrum of human disease phenotypes associated with upregulated type I interferon signaling," Nat. Genet. 46(5):503-509 (2014).
Rodero et al., "Type I interferon-mediated monogenic autoinflammation: The type I interferonopathies, a conceptual overview," J. Exp. Med. 213(12):2527-2538 (2016).
Rodríguez-García et al., "TMEM173 Alternative Spliced Isoforms Modulate Viral Replication through the STING Pathway," ImmunoHorizons 2(11):363-376 (2018).
Roscnbcrg ct al., "Antitumor Effccts in Micc of the Intravcnous Injcction of Attcnuated *Salmonella typhimurium*," Journal of Immunotherapy 25(3):218-225 (2002).
Rosenberg et al., "Cancer immunotherapy: moving beyond current vaccines," Nat. Med. 10(9):909-915 (2004).
Re: Rosenberg et al. (2004) Nat Med 10(9):909-915, Correspondence to the Editor by Mocellin et al., p. 1278, Correspondence to the Editor by Timmerman et al., p. 1279, and Reply by Rosenberg et al., in Nat. Med. 10(12):1278-1280 (2004).
Ruehlmann et al., "MIG (CXCL9) Chemokine Gene Therapy Combines with Antibody-Cytokine Fusion Protein to Suppress Growth and Dissemination of Murine Colon Carcinoma," Cancer Res. 61(23):8498-8503 (2001).
Ruella, M. and Maus, M. V., "Catch me if you can: Leukemia Escape after CD19-Directed T Cell Immunotherapies," Comput. Struct. Biotechnol. J. 14:357-362 (2016).
Ruiz et al., "Identification of two inner-membrane proteins required for the transport of lipopolysaccharide to the outer membrane of *Escherichia coli*," Proc. Natl. Acad. Sci. U.S.A. 105(14):5537-5542 (2008).
Rutsch et al., "A Specific IFIH1 Gain-of-Function Mutation Causes Singleton-Merten Syndrome," Am. J. Hum. Gcnct. 96:275-282 (2015).
Sadelain, M., "CAR therapy: the CD19 paradigm," J. Clin. Invest. 125(9):3392-3400 (2015).
Sanseviero et al., "Anti-CTLA-4 Activates Intratumoral NK Cells and Combined with IL15/IL15Rα Complexes Enhances Tumor Control," Cancer Immunol. Res. 7(8):1371-1380 (2019).
Santana Carrero et al., "IL-15 is a component of the inflammatory milieu in the tumor microenvironment promoting antitumor responses," Proc. Natl. Acad. Sci. U.S.A. 116(2):599-608 (2019).
Schadendorf et al., "Pooled Analysis of Long-Term Survival Data From Phase II and Phase III Trials of Ipilimumab in Unresectable or Metastatic Melanoma," J. Clin. Oncol. 33(17):1889-1894 (2015).
Schaller et al., "Chemokines as adjuvants for immunotherapy: Implications for immune activation with CCL3," Expert Rev. Clin. Immunol. 13(11):1049-1060 (2017).
Scheiermann, J. and Klinman, D. M., "Clinical evaluation of CpG oligonucleotides as adjuvants for vaccines targeting infectious diseases and cancer," Vaccine 32(48):6377-6389 (2014).
Schmidt et al., "Structural and mechanistic analysis of the membrane-embedded glycosyltransferase WaaA required for lipopolysaccharide synthesis," Proc. Natl. Acad. Sci. U.S.A. 109(16):6253-6258 (2012).
Schmitt et al., "Absence of All Components of the Flagellar Export and Synthesis Machinery Differentially Alters Virulence of *Salmonella enterica* Serovar Typhimurium in Models of Typhoid Fever, Survival in Macrophages, Tissue Culture Invasiveness, and Calf Enterocolitis," Infection and Immunity 69(9):5619-5625 (2001).
Schwartz, R. M. and Dayhoff, M. O., "Matrices for detecting distant relationships," in Atlas of Protein Sequence and Structure, National Biomedical Research Foundation, pp. 353-358 (1978).
Servant et al., "Identification of the Minimal Phosphoacceptor Site Required for in Vivo Activation of Interferon Regulatory Factor 3 in Response to Virus and Double-stranded RNA," J. Biol. Chem. 278(11):9441-9447 (2003).
Shaffer et al., "Structural Heterogeneity and Environmentally Regulated Remodeling of *Francisella tularensis* subspecies *novicida* Lipid A Characterized by Tandem Mass Spectrometry," J. Am. Soc. Mass Spectrom. 18(6):1080-1092 (2007).
Shah et al., "Minor Modifications to the Phosphate Groups and the C3' Acyl Chain Length of Lipid A in Two *Bordetella pertussis* Strains, BP338 and 18-323, Independently Affect Toll-like Receptor 4 Protein Activation," J. Biol. Chem. 288(17):11751-11760 (2013).
Sharma et al., "Novel cancer immunotherapy agents with survival benefit: recent successes and next steps," Nat. Rev. Cancer 11(11):805-812 (2011).
Sharma et al., "Primary, Adaptive, and Acquired Resistance to Cancer Immunotherapy," Cell 168:707-723 (2017).
Shaw, A. R. and Suzuki, M., "Recent advances in oncolytic adenovirus therapies for cancer," Curr. Opin. Virol. 21:9-15 (2016).
Sheikhi et al., "Whole Tumor Cell Vaccine Adjuvants: Comparing IL-12 to IL-2 and IL-15," Iran J. Immunol. 13(3):148-166 (2016).
Shi et al., "Combined prokaryotic-cukaryotic delivery and expression of therapeutic factors through a primed autocatalytic positive-feedback loop," Journal of Controlled Release 222:130-140 (2016).
Sirard et al., "Live attenuated *Salmonella*: a paradigm of mucosal vaccines," Immunol. Rev. 171:5-26 (1999).
Sivick et al. "Magnitude of Therapeutic STING Activation Determines CD8+ T Cell-Mediated Antitumor Immunity," Cell Rep. 25(11):3074-3085 (2018).
Smith, T. F. and Waterman, M. S., "Comparison of Biosequences," Adv. Appl. Math. 2:482-489 (1981).
Sokolowski et al., "Oncolytic virotherapy using herpes simplex virus: how far have we come?" Oncolytic Virotherapy 4:207-219 (2015).
Sorenson et al., "Safety and immunogenicity of *Salmonella* typhimurium expressing C-terminal truncated human IL-2 in a murine model," Biologics: Targets & Therapy 4:61-73 (2010).
Sperandeo et al., "Characterization of lptA and lptB, Two Essential Genes Implicated in Lipopolysaccharide Transport to the Outer Membrane of *Escherichia coli*," Journal of Bacteriology 189(1):244-253 (2007).
Sperandeo et al., "Functional Analysis of the Protein Machinery Required for Transport of Lipopolysaccharide to the Outer Membrane of *Escherichia coli*," Journal of Bacteriology 190(13):4460-4469 (2008).
Sperandeo et al., "New Insights into the Lpt Machinery for Lipopolysaccharide Transport to the Cell Surface: LptA-LptC Interaction and LptA Stability as Sensors of a Properly Assembled Transenvelope Complex," Journal of Bacteriology 193(5):1042-1053 (2011).
Spranger et al., "Melanoma-intrinsic β-catenin signalling prevents anti-tumour immunity," Nature 523(7559):231-235 (2015).
Stagg, J. and Smyth, M. J., "Extracellular adenosine triphosphate and adenosine in cancer," Oncogene 29:5346-5358 (2010).
Starks et al., "*Listeria monocytogenes* as a Vaccine Vector: Virulence Attenuation or Existing Antivector Immunity Does Not Diminish Therapeutic Efficacy," J. Immunol. 173:420-427 (2004).
Stritzker ct al., "Enterobacterial tumor colonization in mice depends on bacterial metabolism and macrophages but is independent of chemotaxis and motility," Int. J. Med. Microbiol. 300:449-456 (2010).
Sun et al., "Cyclic GMP-AMP Synthase is a Cytosolic DNA Sensor that Activates the Type-I Interferon Pathway," Science 339(6121):786-791 (2013).
Tayeb et al., "Therapeutic potential of oncolytic Newcastle disease virus: a critical review," Oncolytic Virotherapy 4:49-62 (2015).

(56) References Cited

OTHER PUBLICATIONS

Timiryasova, T. M., "Construction of Recombinant Vaccinia Viruses Using PUV-Inactivated Virus as a Helper," BioTechniques 31(3):534, 536, 538-540 (2001).
Tjuvajev et al., "*Salmonella*-based tumor-targeted cancer therapy: tumor amplified protein expression therapy (TAPET™) for diagnostic imaging," J. Control Release 74(1-3):313-315 (2001).
Toley, B. J. and Forbes, N. S., "Motility is Critical for Effective Distribution and Accumulation of Bacteria in Tumor Tissue," Integr. Biol. (Camb.) 4(2):165-176 (2012).
Tome et al., "Primer Dosing of *S. typhimuium* A1-R Potentiates Tumor-Targeting and Efficacy in Immunocompetent Mice," Anticancer Research 33:97-102 (2013).
Tominaga, A. and Kutsukake, K., "Expressed and cryptic flagellin genes in the H44 and H55 type strains of *Escherichia coli*," Genes Genet. Syst. 82:1-8 (2007).
Topalian et al., "Safety, Activity, and Immune Correlates of Anti-PD-1 Antibody in Cancer," N. Engl. J. Med. 366(26):2443-2454 (2012).
Torres et al., "Bacteria in cancer therapy: beyond immunostimulation," J. Cancer Metastasis Treat. 4:4 (2018), 25 pages.
Toso et al., "Phase I Study of the Intravenous Administration of Attenuated *Salmonella typhimurium* to Patients With Metastatic Melanoma," Journal of Clinical Oncology 20(1): 142-152 (2002).
Traktman, P., "Chapter 27, Poxvirus DNA Replication," in: DNA Replication in Eukaryotic Cells, Cold Spring Harbor Laboratory Press, pp. 775-798 (1996).
Tukel et al., "CsgA is a pathogen-associated molecular pattern of *Salmonella enterica* serotype Typhimurium that is recognized by Toll-like receptor 2," Mol. Microbiol. 58(1):289-304 (2005).
Tyle, P., "Iontophoretic Devices for Drug Delivery," Pharmaceutical Research 3(6):318-326 (1986).
Uusi-Kerttula ct al., "Oncolytic Adenovirus: Strategies and Insights for Vector Design and Immuno-Oncolytic Applications," Viruses 7:6009-6042 (2015).
Vassaux et al., "Bacterial gene therapy strategies," J. Pathol. 208(2):290-298 (2006).
Vaupel, P. and Mayer, A., "Hypoxia-Driven Adenosine Accumulation: A Crucial Microenvironmental Factor Promoting Tumor Progression," in: Oxygen Transport to Tissue XXXVII, Advances in Experimental Medicine and Biology 876, C. E. Elwell et al. (eds.), Springer Science + Business Media, New York, Chp 22, pp. 177-183 (2016).
Veinalde et al., "Oncolytic measles virus encoding interleukin-12 mediates potent antitumor effects through T cell activation," Oncoimmunology 6(4):e1285992 (2017), 12 pages.
Vorachek-Warren et al., "An *Escherichia coli* Mutant Lacking the Cold Shock-induced Palmitoleoy ltransferase of Lipid A Biosynthesis," J. Biol. Chem. 277(16):14186-14193 (2002).
Wang, R. F. and Kushner, S. R., "Construction of versatile low-copy-number vectors for cloning, sequencing and gene expression in *Escherichia coli*" Gene 100:195-199 (1991).
Wang, X. and Quinn, P. J., "Endotoxins: Lipopolysaccharides of Gram-Negative Bacteria," Subcellular Biochemistry 53:3-25 (2010).
Wang, X. and Quinn, P. J., "Lipopolysaccharide: Biosynthetic pathway and structure modification," Progress in Lipid Research 49:97-107 (2010).
Wang et al., "Kdo2-lipid A: structural diversity and impact on immunopharmacology," Biol. Rev. 90:408-427 (2015).
Wang et al., "New technologies in developing recombinant attenuated *Salmonella* vaccine vectors," Microbial Pathogenesis 58:17-28 (2013).
Wang et al., "Structure and biosynthesis of free lipid A molecules that replace lipopolysaccharide in *Francisella novicida*," Biochemistry 45(48):14427-14440 (2006).
Watson et al., "Molecular Biology of the Gene," 4th Edition, The Benjamin/Cummings Publ. Co., Inc, p. 224 (1987), 25 pages.
Williams, A. H. and Raetz, C. R. H., "Structural basis for the acyl chain selectivity and mechanism of UDP-N-acetylglucosamine acyltransferase," Proc. Natl. Acad. Sci. U.S.A. 104(34):13543-13550 (2007).
Winter et al., "The Flagellar Regulator TviA Reduces Pyroptosis by *Salmonella enterica* Serovar Typhi," Infect. Immun. 83(4):1546-1555 (2015).
Wu et al., "Cyclic-GMP-AMP Is An Endogenous Second Messenger in Innate Immune Signaling by Cytosolic DNA," Science 339(6121):826-830 (2013).
Xic ct al., "Dampened STING-Dependent Interferon Activation in Bats," Cell Host & Microbe 23(3):297-301.e4 (2018).
Xie et al., "Molecular cloning and functional characterization of porcine stimulator of interferon genes (STING)," Dev. Comp. Immunol. 34(8):847-854 (2010).
Xu et al., "Effective Cancer Vaccine Platform Based on Attenuated *Salmonella* and a Type III Secretion System," Cancer Res. 74(21):6260-6270 (2014).
Yamamoto et al., "Recent advances in genetic modification of adenovirus vectors for cancer treatment," Cancer Sci. 108(5):831-837 (2017).
Yasutake et al., "Comparison of antitumor activity of *Lactobacillus casei* with other bacterial immunopotentiators," Med. Microbiol. Immunol. 173(3):113-125 (1984).
Yee, C., "Adoptive T Cell Therapy for Cancer: Boutique Therapy or Treatment Modality?" Clin. Cancer Res. 19(17):4550-4552 (2013).
Yin et al., "Modulation of the Intratumoral Immune Landscape by Oncolytic Herpes Simplex Virus Virotherapy," Front. Oncol. 7:136 (2017), 7 pages.
Ylä-Pelto et al., "Therapeutic Use of Native and Recombinant Enteroviruses," Viruses 8:57 (2016), 15 pages.
Yokoda et al., "Oncolytic Adenoviruses in Gastrointestinal Cancers," Biomedicines 6:33 (2018), 13 pages.
Yoon et al., "Application of genetically engineered Salmonella typhimurium for interferon-gamma-induced therapy against melanoma," European Journal of Cancer 70:48-61 (2017).
Yu et al., "Explicit hypoxia targeting with tumor suppression by creating an "obligate" anaerobic *Salmonella typhimurium* strain," Scientific Reports 2:436 (2012), 10 pages.
Yu et al., "Oncolytic vaccinia therapy of squamous cell carcinoma," Mol. Cancer 8:45 (2009), 9 pages.
Yu et al., "Regression of human pancreatic tumor xenografts in mice after a single systemic injection of recombinant vaccinia virus GLV-1h68," Mol. Cancer Ther. 8(1):141-151 (2009).
Yu et al., "Tumor-immune profiling of murine syngeneic tumor models as a framework to guide mechanistic studies and predict therapy response in distinct tumor microenvironments," PLoS ONE 13(11):e0206223 (2018).
Yu et al., "Visualization of tumors and metastases in live animals with bacteria and vaccinia virus encoding light-emitting proteins," Nat. Biotech. 22(3):313-320 (2004).
Zakikhany et al., "Unphosphorylated CsgD controls biofilm formation in *Salmonella enterica* serovar Typhimurium," Molecular Microbiology 77(3):771-786 (2010).
Zeng et al., "Flagellin is the Major Proinflammatory Determinant of Enteropathogenic *Salmonella*," J. Immunol. 171:3668-3674 (2003).
Zhang et al., "Characterization of lipid A in *Cronobacter sakazakii*," Eur. J. Mass Spectrom. 16:531-538 (2010).
Zhang et al., "Chloroquine enhanced the anticancer capacity of VNP 20009 by inhibiting autophagy," Scientific Reports 6(1):29774 (2016), 10 pages.
Zhang et al., "Eradication of Solid Human Breast Tumors in Nude Mice with an Intravenously Injected Light-Emitting Oncolytic Vaccinia Virus," Cancer Res. 67(20):10038-10046 (2007).
Zhang et al., "Intratumoral Delivery and Suppression of Prostate Tumor Growth by Attenuated *Salmonella enterica* serovar *typhimurium* Carrying Plasmid-Based Small Interfering RNAs," Cancer Res. 67(12):5859-5864 (2007).
Zhao et al., "Efficacy against lung metastasis with a tumor-targeting mutant of *Salmonella typhimurium* in immunocompetent mice," Cell Cycle 11(1):187-193 (2012).

(56) References Cited

OTHER PUBLICATIONS

Zhao et al., "Strategic Combinations: The Future of Oncolytic Virotherapy with Reovirus," Mol. Cancer Ther. 15(5):767-773 (2016).
Zhao et al., "Targeted Therapy with a *Salmonella typhimurium* Leucine-Arginine Auxotroph Cures Orthotopic Human Breast Tumors in Nude Mice," Cancer Res. 66(15):7647-7652 (2006).
Zhao et al., "Tumor location impacts immune response in mouse models of colon cancer," Oncotarget 8(33):54775-54787 (2017).
Zhao et al., "Tumor-targeting bacterial therapy with amino acid auxotrophs of GFP-expressing *Salmonella typhimurium*," Proc. Natl. Acad. Sci. U.S.A. 102(3):755-760 (2005).
Zheng et al., "Two-step enhanced cancer immunotherapy with engineered *Salmonella typhimurium* secreting heterologous flagellin," Sci. Transl. Med. 9(376):eaak9537 (2017), 34 pages.
Zheng et al., "Targeted Cancer Therapy Using Engineered *Salmonella typhimurium*," Chonnam Med. J. 52:173-184 (2016).
Zheng et al., "Tumor Amplified Protein Expression Therapy: *Salmonella* as a Tumor-Selective Protein Delivery Vector," Oncol. Res. 12:127-135 (2000).
Zielinski et al., "Dissecting the human immunologic memory for pathogens," Immunol. Rev. 240:40-51 (2011).
Zitvogel et al., "Type I interferons in anticancer immunity" Nature Reviews Immunology 15:405-414 (2015).
Zu, C. and Wang, J., "Tumor-colonizing bacteria: A potential tumor targeting therapy," Crit. Rcv. Microbiol. 40(3):225-235 (2014).
Glickman et al., Actym Therapeutics Poster Presentation, entitled "STACT-TREX1: A Novel Tumor-Targeting Systemically-Delivered STING Pathway Agonist Demonstrates Robust Anti-Tumor Efficacy in Multiple Murine Cancer Models." Abstract #P235. Presented at the Society for Immunotherapy of Cancer (SITC) Annual Meeting, in Washington, D.C., on Nov. 9, 2018, 1 page.
Makarova ct al., Actym Therapeutics Poster Presentation, entitled "STACT-TREX1: A Systemically-Administered STING Pathway Agonist Targets Tumor-Resident Myeloid Cells and Induces Adaptive Anti-Tumor Immunity in Multiple Preclinical Models," Abstract #5016. Presented at the American Association for Cancer Research (AACR) Annual Meeting, in Atlanta, GA, on Apr. 3, 2019, 1 page.
Rae et al., Actym Therapeutics Poster Presentation, entitled "STACT: A novel Tumor-Targeting, Systemically-Administered Delivery Platform Capable of Targeting Intractable Pathways and Precise Immuno-Modulation of the Tumor Microenvironment." Abstract #4782. Presented at the American Association for Cancer Research (AACR) Annual Meeting, in Atlanta, GA, on Apr. 3, 2019, 1 page.
Christopher D. Thanos, Ph.D., Actym Therapeutics Presentation, entitled "A Novel Systemically Delivered STING Pathway Agonist Therapy Demonstrates Robust Anti-Tumor Efficacy in Multiple Murine Cancer Models." Presented at the 15th Annual PEGS Conference in Boston, MA, on Apr. 12, 2019, 35 pages.
Glickman et al., Actym Therapeutics Abstract, entitled "STACT: A Novel Therapeutic Platform that Delivers Immunomodulatory Payloads to Tumor-Resident Myeloid Cells After IV Dosing and Demonstrates Potent Anti-Tumor Efficacy in Preclinical Studies." Abstract #P482. Journal for ImmunoTherapy of Cancer 7(Suppl 1):263, Published on Nov. 6, 2019, 2 pages.
Glickman et al., Actym Therapeutics Poster Presentation, entitled "STACT: A Novel Therapeutic Platform that Delivers Immunomodulatory Payloads to Tumor-Resident Myeloid Cells After IV Dosing and Demonstrates Potent Anti-Tumor Efficacy in Preclinical Studies." Poster #P482. Presented at the Society for Immunotherapy of Cancer (SITC) Annual Meeting, in National Harbor, MD, on Nov. 9, 2019, 1 page.
Actym Therapeutics Presentation, entitled "The Next Frontier in Immuno-Oncology." Presented at the 39th Annual J. P. Morgan Health Care Conference, held virtually on Jan. 11-14, 2021, 47 pages.
Glickman, L. H., Actym Therapeutics Presentation, entitled "STACT: A Novel Therapeutic Platform That Delivers Combination STING Immunotherapy To Tumor-Resident Myeloid Cells After IV Dosing." Presented on May 26, 2021, at the STING & TLR-Targeting Therapies Digital Summit, held virtually on May 25-27, 2021, 36 pages.
Kehoe et al., Actym Therapeutics Abstract, entitled "ACTM-838: A microbial-based immunotherapy that delivers combination IL-15 + engineered STING to tumor-resident APCs after IV dosing in T-cell excluded solid tumors." SITC 2021 Abstract; received on Oct. 20, 2021, 2 pages.
Kehoe et al., Actym Therapeutics Poster, entitled "ACTM-838: A microbial-based immunotherapy that delivers combination IL-15 + engineered STING to tumor-resident APCs after IV dosing in T-cell excluded solid tumors." Presentation #853, Presented at the SITC meeting in Washington, D.C., on Nov. 12. 2021, 1 page.
Cheung et al., Actym Therapeutics Abstract, entitled "STACT IL-15plex + eSTING: A microbial-based, IV-delivered IL-15 + engineered STING immunotherapy that specifically targets and reprograms immunosuppressive TAMs into hybrid MI/M2 phagocytic and T-cell priming macrophages." AACR 2022 Abstract; received on Jan. 9, 2022, 2 pages.
Actym Therapeutics Presentation, entitled "The Next Frontier in Immuno-Oncology." BMGF Presentation, Feb. 7, 2022, 22 pages.
Actym Therapeutics, Inc., "The next frontier in immuno-oncology," BioPharma Dealmakers, B22, Mar. 2019, 1 page.
Illumina Ventures Portfolio Company Spotlight, entitled, "Acytm Therapeutics: A New Path to Immunotherapy." Published Aug. 2021 [online]; retrieved on Nov. 8, 2021, from: <URL:.illuminaventures.com/spotlight-actym-2021, 2 pages.
Actym Therapeutics Press Release, entitled "Actym Therapeutics Announces Lead Candidate for Clinical Development, Presentation at SITC." Published Nov. 12, 2021 [online]; retrieved on Nov. 15, 2021, from: <URL:prnewswire.com/news-releases/actym-therapeutics-announces-lead-candidate-for-clinical-development-presentation-at-sitc-301422752.html, 3 pages.
Actym Therapeutics Press Release, entitled "Actym Therapeutics Announces Issuance of US Patent." Published Feb. 14, 2022 [online]; retrieved Mar. 10, 2022, from: <URL: prnewswire.com/news-releases/actym-therapeutics-announces-issuance-of-us-patent-301481063.html, 2 pages.
Actym Therapeutics Press Release, entitled "Actym Therapeutics and Wacker Biotech Sign Manufacturing Contract for Actym's Lead Candidate for the Treatment of Solid Tumors." Published Feb. 28, 2022 [online]; retrieved Mar. 10, 2022, from <URL: prnewswire.com/news-releases/actym-therapeutics-and-wacker-biotech-sign-manufacturing-contract-for-actyms-lead-candidate-for-the-treatment-of-solid-tumors-301491770.html, 4 pages.
Invitation to Pay Additional Fees and Partial International Search, mailed Oct. 17, 2018, in connection with International Patent Application No. PCT/US2018/041713, 25 pages.
Response to Invitation to Pay Additional Fees, submitted Nov. 15, 2018, in connection with International Patent Application No. PCT/US2018/041713, 13 pages.
International Search Report and Written Opinion, mailed Jan. 3, 2019, in connection with International Patent Application No. PCT/US2018/041713, 34 pages.
Response, filed May 13, 2019, to International Search Report and Written Opinion, mailed Jan. 3, 2019, in connection with International Patent Application No. PCT/US2018/041713, 55 pages.
Invitation to Restrict or Pay Additional Examination Fees, mailed Jun. 7, 2019, in connection with International Patent Application No. PCT/US2018/041713, 9 pages.
Response, filed Jul. 5, 2019, to Invitation to Restrict or Pay Additional Examination Fees, mailed Jun. 7, 2019, in connection with International Patent Application No. PCT/US2018/041713, 4 pages.
Written Opinion of the International Preliminary Examining Authority, mailed Aug. 6, 2019, in connection with International Patent Application No. PCT/US2018/041713, 13 pages.
Replacement Claim Sets, filed Sep. 6, 2019, and Response, filed Sep. 5, 2019, to the Written Opinion of the International Preliminary Examining Authority, mailed Aug. 6, 2019, in connection with International Patent Application No. PCT/US2018/041713, 61 pages.

(56) References Cited

OTHER PUBLICATIONS

International Preliminary Report on Patentability (Chapter II of the PCT), dated Oct. 14, 2019, in connection with International Patent Application No. PCT/US2018/041713, 17 pages.
Office Action, mailed Mar. 11, 2020, in connection with U.S. Appl. No. 16/033,187, 16 pages.
Response, filed Apr. 10, 2020, to Office Action, mailed Mar. 11, 2020, in connection with U.S. Appl. No. 16/033,187, 19 pages.
Final Office Action, issued Jul. 14, 2020, in connection with U.S. Appl. No. 16/033,187, 9 pages.
Request for Continued Examination (RCE) and Preliminary Amendment, filed Aug. 12, 2020, in response to the Final Office Action, issued Jul. 14, 2020, in connection with U.S. Appl. No. 16/033,187, 11 pages.
Office Action, issued Nov. 3, 2020, in connection with U.S. Appl. No. 16/033,187, 8 pages.
Response, filed Nov. 24, 2020, to Office Action, issued Nov. 3, 2020, in connection with U.S. Appl. No. 16/033,187, 11 pages.
Office Action, issued Mar. 11, 2021, in connection with U.S. Appl. No. 16/033,187, 10 pages.
Response, filed Apr. 7, 2021, to Office Action, issued Mar. 11, 2021, in connection with U.S. Appl. No. 16/033,187, 9 pages.
Final Office Action, issued Jul. 15, 2021, in connection with U.S. Appl. No. 16/033,187, 6 pages.
Amendment After Final, filed Jul. 16, 2021, in response to the Final Office Action, issued Jul. 15, 2021, in connection with U.S. Appl. No. 16/033,187, 7 pages.
Communication Pursuant to Rule 164(2)(b) and Article 94(3) EPC (Examination Report), dated Jun. 10, 2021, issued in connection with European Patent Application No. 18 752 908.6, 13 pages.
Response, filed Mar. 25, 2022, to the Communication under Rule 164(2)(b) EPC and Article 94(3) EPC, dated Jun. 10, 2021, that issued in connection with European Patent Application No. 18 752 908.6, 11 pages.
Office Action, mailed Mar. 16, 2021, in connection with Japanese Patent Application No. 2020-523685 [English Summary of Office Action; English translation of Office Action; and original document as issued in Japanese], 10 pages.
Response, filed Aug. 12, 2021, to Office Action, mailed Mar. 16, 2021, in connection with Japanese Patent Application No. 2020-523685 [English instructions; Response as filed in Japanese with references cited; English translation of claims; and more legible copies of the references cited], 151 pages.
Office Action, mailed Oct. 12, 2021, in connection with Japanese Patent Application No. 2020-523685 [English summary of Office Action; English translation of Office Action; and original document as issued in Japanese], 5 pages.
Response, filed Jan. 7, 2022, to Office Action, mailed Oct. 12, 2021, in connection with Japancsc Patent Application No. 2020-523685 [English instructions; original document as filed in Japanese; and English translation of the pending claims], 17 pages.
Decision of Rejection, mailed Jan. 25, 2022, in connection with Japanese Patent Application No. 2020-523685 [English summary of Office Action; English translation of Office Action; and original document as issued in Japanese], 5 pages.
Invitation to Pay Additional Fees and Partial International Search, mailed Oct. 18, 2019, in connection with International Patent Application No. PCT/US2019/041489, 22 pages.
Response, filed Nov. 15, 2019, to Invitation to Pay Additional Fees and Partial International Scarch, mailed Oct. 18, 2019, in connection with International Patent Application No. PCT/US2019/041489, 17 pages.
International Search Report and Written Opinion, mailed Jan. 16, 2020, in connection with International Patent Application No. PCT/US2019/041489, 30 pages.
Demand for International Preliminary Examination (Chapter II) and Response under Article 34(2)(b) PCT, filed May 11, 2020, in response to the International Search Report and Written Opinion, mailed Jan. 16, 2020, in connection with International Patent Application No. PCT/US2019/041489, 54 pages.
Written Opinion of the International Preliminary Examining Authority, mailed May 27, 2020, in connection with International Patent Application No. PCT/US2019/041489, 11 pages.
Response, filed Jun. 29, 2020, to the Written Opinion of the International Preliminary Examining Authority, mailed May 27, 2020, in connection with International Patent Application No. PCT/US2019/041489, 63 pages.
International Preliminary Report on Patentability (Chapter II of the PCT), mailed Oct. 21, 2020, in connection with International Patent Application No. PCT/US2019/041489, 13 pages.
Response, filed Dec. 31, 2020, to the International Preliminary Report on Patentability (Chapter II of the PCT), mailed Oct. 21, 2020, in connection with International Patent Application No. PCT/US2019/041489, 28 pages.
International Preliminary Report on Patentability (Chapter II of the PCT), mailed Jan. 28, 2021, in connection with International Patent Application No. PCT/US2019/041489, 12 pages.
Examiner's Report, dated Dec. 24, 2021, in connection with Canadian Patent Application No. 3,106,143, 4 pages.
Invitation to Pay Additional Fees and Partial International Search, dated Jun. 12, 2020, issued in connection with International Patent Application No. PCT/US2020/020240, 23 pages.
International Search Report and Written Opinion, mailed Aug. 12, 2020, in connection with International Patent Application No. PCT/US2020/020240, 29 pages.
Response, filed Sep. 18, 2020, to the Invitation to Pay Additional Fees and Partial International Search, dated Jun. 12, 2020, that issued in connection with International Patent Application No. PCT/US2020/020240, 52 pages.
International Search Report and Written Opinion, mailed Nov. 11, 2020, in connection with International Patent Application No. PCT/US2020/020240, 35 pages.
PCT Demand for International Preliminary Examination (Chapter II), and Response and Amendment under Article 34 PCT, filed Dec. 24, 2020, in response to the International Search Report and Written Opinion, mailed Nov. 11, 2020, in connection with International Patent Application No. PCT/US/2020/020240, 86 pages.
Invitation to Restrict or Pay Additional Fees, mailed Mar. 1, 2021, in connection with International Patent Application No. PCT/US2020/020240, 7 pages.
Response, filed Mar. 31, 2021, to the Invitation to Restrict or Pay Additional Fees, mailed Mar. 1, 2021, in connection with International Patent Application No. PCT/US2020/020240, 53 pages.
Written Opinion of the International Preliminary Examining Authority, mailed May 3, 2021, in connection with International Patent Application No. PCT/US2020/020240, 15 pages.
Rcsponse, filcd Jun. 17, 2021, to the Writtcn Opinion of the Intcrnational Prcliminary Examining Authority, mailed May 3, 2021, in connection with International Patent Application No. PCT/US2020/020240, 67 pages.
International Preliminary Report on Patentability (Chapter II of the PCT), mailed Jul. 14, 2021, in connection with International Patent Application No. PCT/US2020/020240, 19 pages.
International Search Report and Written Opinion, mailed May 21, 2021, in connection with International Patent Application No. PCT/US2020/060307, 38 pages.
Rcsponsc, filed Oct. 25, 2021, to Invitation to Submit Amcndmcnts, datcd Sep. 24, 2021, in connection with International Application No. PCT/US2020/060307 [Amendments to the claims, description, and drawings in accordance with Art. 34 PCT; arguments in response to the WO-ISA; and request for rectification of obvious errors under Rule 91 PCT], 196 pages.
Written Opinion of the International Preliminary Examining Authority, mailed Nov. 10, 2021, in connection with International Patent Application No. PCT/US2020/060307, 21 pages.
Response, filed Dec. 10, 2021, to the Written Opinion of the International Preliminary Examining Authority, dated Nov. 10, 2021, in connection with International Patent Application No. PCT/US2020/060307, 24 pages.
International Preliminary Report on Patentability (Chapter II of the PCT), dated Jan. 31, 2022, in connection with International Patent Application No. PCT/US2020/060307, 370 pages.

(56) References Cited

OTHER PUBLICATIONS

Letter/Written Disclosure of the Supplemental Information Disclosure Statement for the above-referenced application, filed herewith on Jan. 15, 2024, 3 pages.
Notice of Acceptance, dated Jan. 7, 2025, in connection with Australian Patent Application No. 2020229875, 3 pages.
Letter/Written Disclosure of the Supplemental Information Disclosure Statement for the above- referenced application, filed herewith on Dec. 3, 2024, 3 pages.
Office Action, mailed Nov. 5, 2024, issued in connection with Japanese Patent Application No. 2021-549951 [English summary, English translation, and document as issued in Japanese], 13 pages.
U.S. Appl. No. 17/483,523, filed Sep. 23, 2021, 2022/0017904, Jan. 20, 2022, Thanos et al.
U.S. Appl. No. 19/214,739, filed May 21, 2025, Thanos et al.
U.S. Appl. No. 17/573,569, filed Jan. 11, 2022, 2022/0135980, May 5, 2022, Thanos et al.
U.S. Appl. No. 17/320,200, filed May 13, 2021, 2022/0380720, Dec. 1, 2022, Glickman et al.
U.S. Appl. No. 17/590,700, filed Feb. 1, 2022, 2022/0154136, May 19, 2022, Thanos et al.
U.S. Appl. No. 17/569,290, filed Jan. 5, 2022, 2022/0119824, Apr. 21, 2022, Glickman et al.
U.S. Appl. No. 18/660,096, filed May 9, 2024, 2024/0293478, Sep. 5, 2024, Udyavar et al.
U.S. Appl. No. 16/033,187, filed Jul. 11, 2018, U.S. Pat. No. 11,168,326, Nov. 9, 2021, Thanos et al.
U.S. Appl. No. 16/554,478, filed Aug. 28, 2019, U.S. Pat. No. 11,242,528, Feb. 8, 2022, Thanos et al.
U.S. Appl. No. 17/560,080, filed Dec. 22, 2021, U.S. Pat. No. 12,012,600, Jun. 18, 2024, Thanos et al.
U.S. Appl. No. 16/520,155, filed Jul. 23, 2019, U.S. Pat. No. 11,779,612, Oct. 10, 2023, Thanos et al.
U.S. Appl. No. 17/037,455, filed Sep. 29, 2020, U.S. Pat. No. 12,357,661, Jul. 15, 2025, Thanos et al.
U.S. Appl. No. 17/747,689, filed May 18, 2022, U.S. Pat. No. 12,201,653, Jan. 21, 2025, Thanos et al.
U.S. Appl. No. 17/934,166, filed Sep. 21, 2022, U.S. Pat. No. 12,226,439, Feb. 18, 2025, Thanos et al.
U.S. Appl. No. 16/824,500, filed Mar. 19, 2020, U.S. Pat. No. 12,024,709, Jul. 2, 2024, Thanos et al.
Letter/Written Disclosure of the Supplemental Information Disclosure Statement for the above-referenced application, filed herewith on Sep. 16, 2024, 2 pages.
Fang et al., Actym Therapeutics Poster, entitled "ACTM-838, a Novel Immunotherapy that Enriches in Solid Tumors after IV dosing and Comprehensively Reverses the Immunosuppressive TME to Promote Durable Anti-tumor Immunity." Poster #576. Presented at the AACR meeting in Orlando, FL, on Apr. 16, 2023, 1 page.
Liang et al., "Genetically engineered *Salmonella* Typhimurium: Recent advances in cancer therapy," Cancer Letters 448:168-181 (2019).
Tang, E. D., and Wang, C., "Single Amino Acid Change in STING Leads to Constitutive Active Signaling, " PLoS ONE 10(3):e0120090 (2015), 10 pages.
Response, filed Mar. 7, 2023, to Office Action, dated Oct. 7, 2022, in connection with U.S. Appl. No. 16/520,155 [Response as filed with Statement of Prior Art Exception Under 35 U.S.C. § 102(B)(2)(C)], 16 pages.
Notice of Allowance, mailed Jul. 17, 2023, in connection with U.S. Appl. No. 16/520,155, 7 pages.
Response, filed Aug. 7, 2023, to Office Action, dated Feb. 7, 2023, in connection with U.S. Appl. No. 17/037,455 [Response as filed with 3 cited references], 151 pages.
Final Office Action, dated Aug. 29, 2023, in connection with U.S. Appl. No. 17/037,455, 29 pages.
Office Action, dated Mar. 14, 2024, in connection with U.S. Appl. No. 17/037,455, 23 pages.
Office Action, dated Mar. 28, 2024, in connection with U.S. Appl. No. 17/934,166, 11 pages.
Response, filed Jun. 27, 2024, to Office Action, dated Mar. 28, 2024, in connection with U.S. Appl. No. 17/934,166 [Response as filed with two references], 51 pages.
Response, filed Jun. 22, 2023, to Examination Report, dated Oct. 8, 2022, in connection with Australian Patent Application No. 2019301699, 131 pages.
Examination Report, dated Jul. 8, 2023, in connection with Australian Patent Application No. 2019301699, 5 pages.
Response, filed Sep. 29, 2023, to Examination Report, dated Jul. 8, 2023, in connection with Australian Patent Application No. 2019301699 [document as filed with cited reference], 58 pages.
Notice of Acceptance, issued Oct. 20, 2023, in connection with Australian Patent Application No. 2019301699, 3 pages.
Response, filed Apr. 21, 2023, to Examiner's Report, dated Dec. 23, 2022, in connection with Canadian Patent Application No. 3,106,143, 39 pages.
Examiner's Report, dated Jul. 25, 2023, in connection with Canadian Patent Application No. 3,106,143, 4 pages.
Response, filed Nov. 24, 2023, to Examiner's Report, dated Jul. 25, 2023, in connection with Canadian Patent Application No. 3,106,143, 88 pages.
Response, filed Jun. 7, 2024, to Examiner's Report, dated Dec. 9, 2022, in connection with Canadian Patent Application No. 3,176,812, 71 pages.
Response, filed Mar. 13, 2023, to Office Action, issued Aug. 29, 2022, in connection with Chinese Patent Application No. 201980059088.5 [English instructions for response; document as filed in Chinese; and English translation of the claims], 55 pages.
Office Action, dated Aug. 5, 2023, in connection with Chinese Patent Application No. 201980059088.5 [English translation of office action; and original document as issued in Chinese], 14 pages.
Response, to Office Action dated Aug. 5, 2023, in connection with Chinese Patent Application No. 201980059088.5 [English instructions for response; documents as filed in Chinese; and English translation of claims as filed], received on Dec. 22, 2023, 68 pages.
Notification of Granting a Patent Right, issued Jan. 5, 2024, in connection with Chinese Patent Application No. 201980059088.5 [English translation of notification; and original document as issued in Chinese], 4 pages.
Office Action, dated Nov. 15, 2023, and received Feb. 13, 2024, issued in connection with Eurasian Patent Application No. 202100009 [English translation of Action, and document as issued in Russian], 7 pages.
Response, filed Jun. 29, 2023, to Communication pursuant to Rule 164(2)(b) and Article 94(3) EPC (Examination Report), dated Sep. 15, 2022, issued in connection with European Patent Application No. 19 745 021.6, 39 pages.
Response, filed May 19, 2023, to Office Action, issued Dec. 20, 2022, in connection with Japanese Patent Application No. 2021-500579 [English instructions for response; response as-filed in Japanese; and English translation of pending claims], 66 pages.
Office Action, mailed Jun. 20, 2023, in connection with Japanese Patent Application No. 2021-500579 [English translation of Office Action, and document as issued in Japanese], 5 pages.
Response, filed Jul. 11, 2023, to Office Action, mailed Jun. 20, 2023, in connection with Japanese Patent Application No. 2021-500579 [English instructions for response; documents as filed in Japanese; and English translation of claims as filed], 27 pages.
Decision to Grant, issued Aug. 1, 2023, in connection with Japanese Patent Application No. 2021-500579 [English reporting letter, and original document as issued in Japanese], 6 pages.
Office Action, issued May 2, 2023, in connection with Korean Patent Application No. 10-2021-7004205 [English translation of Office Action; and document as issued in Korean], 14 pages.
Response, filed Aug. 11, 2023, to Office Action, issued May 2, 2023, in connection with Korean Patent Application No. 10-2021-7004205 [English instructions for response; document as filed in Korean, with cited references; and English translation of marked-up and clean claims as amended], 441 pages.

(56) References Cited

OTHER PUBLICATIONS

Notice of Final Rejection, issued Jan. 29, 2024, in connection with Korean Patent Application No. 10-2021-7004205 [English translation of Office Action; and document as issued in Korean], 6 pages.
Response, filed Apr. 30, 2024, to Notice of Final Rejection, issued Jan. 29, 2024, in connection with Korean Patent Application No. 10-2021-7004205 [English instructions for response; Document as filed in Korean; and English translation of marked-up and clean claims as amended], 79 pages.
Office Action, dated Jun. 24, 2024, in connection with Korean Patent Application No. 10-2021-7004205 [English translation of Office Action; and Document as issued in Korean], 9 pages.
Office Action, dated Aug. 27, 2024, in connection with Korean Patent Application No. 10-2024-7014462 [English translation of Office Action; and Document as issued in Korean], 9 pages.
Examination Report, dated Mar. 20, 2024, in connection with New Zealand Patent Application No. 771198, 5 pages.
Written Opinion, dated Feb. 26, 2024, in connection with Singapore Patent Application No. 11202100023X, 8 pages.
Response, filed Jul. 24, 2024, to Written Opinion, dated Feb. 26, 2024, in connection with Singapore Patent Application No. 11202100023X [Response as filed, and three references as provided with Response], 109 pages.
Office Action, issued Mar. 14, 2023, in connection with U.S. Appl. No. 16/824,500, 21 pages.
Response, filed Sep. 14, 2023, to Office Action, issued Mar. 14, 2023, in connection with U.S. Appl. No. 16/824,500, 53 pages.
Office Action, issued Dec. 5, 2023, in connection with U.S. Appl. No. 16/824,500, 10 pages.
Response, filed Dec. 28, 2023, to Office Action, issued Dec. 5, 2023, in connection with U.S. Appl. No. 16/824,500, 25 pages.
Notice of Allowance, mailed Feb. 28, 2024, in connection with U.S. Appl. No. 16/824,500, 9 pages.
Examination Report, dated Mar. 28, 2024, in connection with Australian Patent Application No. 2020229875, 4 pages.
Response, filed Jul. 17, 2024, to Examination Report, dated Mar. 28, 2024, in connection with Australian Patent Application No. 2020229875, 32 pages.
Response, filed May 2, 2023, to Examiner's Report, dated Jan. 3, 2023, in connection with Canadian Patent Application No. 3,131,017, 76 pages.
Examiner's Report, dated Sep. 14, 2023, in connection with Canadian Patent Application No. 3,131,017 [D1=Xie et al. (2018) Cell Host & Microbe 23:297-301.e4; D3=KR 10-2018-0066296; D4=Xie et al. (2010) Developmental and Comparative Immunology 34(8):847-854; D5=Burdette et al. (2011) Nature 478(7370):515-518], 4 pages.
Response, filed Jan. 15, 2024, to Examiner's Report, dated Sep. 14, 2023, in connection with Canadian Patent Application No. 3,131,017, 68 pages.
Examiner's Report, dated May 28, 2024, in connection with Canadian Patent Application No. 3,131,017, 3 pages.
Office Action, issued Jul. 17, 2024, in connection with Chinese Patent Application No. 202080031041.0 [English translation of the Office Action and Search Report, and document as issued in Chinese], 15 pages.
Office Action, issued Jul. 19, 2023, and received via e-mail from Foreign Associate on Aug. 29, 2023, in connection with Eurasian Patent Application No. 202100228 [E-mail from Foreign Associate and English translation of Office Action as attached to e-mail], 16 pages.
Office Action, dated Feb. 13, 2024, issued in connection with Japanese Patent Application No. 2021-549951 [English summary, English translation, and documents as issued in Japanese], 13 pages.
Response, filed Aug. 13, 2024, to Office Action, dated Feb. 13, 2024, issued in connection with Japanese Patent Application No. 2021-549951 [English instructions, documents as filed in Japanese, and English translation of claims], 82 pages.
Search Report and Written Opinion, dated May 5, 2023, in connection with Singapore Patent Application No. 11202108459Q, 13 pages.
Response, filed Oct. 5, 2023, to Search Report and Written Opinion, dated May 5, 2023, in connection with Singapore Patent Application No. 11202108459Q, 28 pages.
Response, filed Apr. 22, 2024, to Examiner's Report, dated Dec. 21, 2022, in connection with Canadian Patent Application No. 3,161,450, 89 pages.
Examiner's Report, dated Aug. 22, 2024, in connection with Canadian Patent Application No. 3,161,450, 10 pages.
Examiner's Report, dated Feb. 24, 2023, in connection with Canadian Patent Application No. 3,177,479, 7 pages.
Response, filed Jun. 26, 2023, to Examiner's Report, dated Feb. 24, 2023, in connection with Canadian Patent Application No. 3,177,479, 110 pages.
Examiner's Report, dated Sep. 13, 2023, in connection with Canadian Patent Application No. 3,177,479, 7 pages.
Response, filed Jan. 15, 2024, to Examiner's Report, dated Sep. 13, 2023, in connection with Canadian Patent Application No. 3,177,479 [Response as filed including references cited], 104 pages.
Response, filed Sep. 13, 2024, to Office Action, dated Mar. 14, 2024, in connection with U.S. Appl. No. 17/037,455, 55 pages.
Letter/Written Disclosure of the Supplemental Information Disclosure Statement for the above-referenced application, filed herewith on Sep. 10, 2025, 3 pages.
Fang et al., Actym Therapeutics Abstract, entitled "ACTM-838, a Novel Immunotherapy that Enriches in Solid Tumors after IV dosing and Comprehensively Reverses the Immunosuppressive TME to Promote Durable Anti-tumor Immunity." Abstract #576. Cancer Res. 83(7_Supplement):576, published on Apr. 1, 2023, 2 pages.
Actym Therapeutics Press Release, entitled "Actym Therapeutics Announces Issuance of US Patents." Published Jun. 2, 2025 [online]; retrieved Jun. 4, 2025, from <URL:businesswire.com/news/home/20250602896710/en/Actym-Therapeutics-Announces-Issuance-of-US-Patents?feedref=JjAwJuNHiystnCoBq_hl-bV7DTIYheT0D-lvT4 bKFzt EW40VMdK6eG-WLfRGUE1fJraLPL1g6AeUGJICT Ys7Oafol48Kkc8KJgZoTHgMu0w8LYSbRdYOj2VdwnuKwa>, 2 pages.
Cerboni et al., "Intrinsic antiproliferative activity of the innate sensor STING in T lymphocytes," J. Exp. Med. 214(6):1769-1785 (2017).
Chen et al., "STING signaling pathway and its function," Medical Recapitulate 23(14):2705-2709, 2714 (2017), English translation of reference, original reference in Chinese, 12 pages.
Forbes et al., "White paper on microbial anti-cancer therapy and prevention," Journal for ImmunoTherapy of Cancer 6:78 (2018), 24 pages.
Hou et al., "Non-canonical NF-κB Antagonizes STING Sensor-Mediated DNA Sensing in Radiotherapy," Immunity 49:490-503 (2018).
Final Office Action, dated Dec. 17, 2024, in connection with U.S. Appl. No. 17/037,455, 12 pages.
Response, filed Feb. 18, 2025, to Final Office Action, dated Dec. 17, 2024, in connection with U.S. Appl. No. 17/037,455, 32 pages.
Notice of Allowance, mailed Mar. 6, 2025, in connection with U.S. Appl. No. 17/037,455, 7 pages.
Response, filed Jan. 13, 2025, to Office Action, dated Nov. 15, 2023, issued in connection with Eurasian Patent Application No. 202100009 [English instructions with two provided references, and documents as filed in Russian], 164 pages.
Officc Action, mailed Sep. 3, 2024, in conncction with Japancsc Patcnt Application No. 2023-137908 [English translation of Office Action, and Document as issued in Japanese], 5 pages.
Response, filed. Mar. 3, 2025, to Office Action, mailed Sep. 3, 2024, in connection with Japanese Patent Application No. 2023-137908 [English instructions; response as filed in Japanese; copies of five references cited; and English translation of pending claims], 227 pages.
Decision to Grant, dated Jul. 1, 2025, in connection with Japanese Patent Application No. 2023-137908 [English reporting letter, and Document as issued in Japanese], 6 pages.

(56) References Cited

OTHER PUBLICATIONS

Response, filed Sep. 24, 2024, to Office Action, dated Jun. 24, 2024, in connection with Korean Patent Application No. 10-2021-7004205 [English instructions; Response as filed in Korean; 3 references as provided with the response; and English translation of marked up and clean claims], 182 pages.
Office Action, dated Jan. 30, 2025, in connection with Korean Patent Application No. 10-2021-7004205 [English translation of Office Action; and Document as issued in Korean], 6 pages.
Response, filed Mar. 24, 2025, to Office Action, dated Jan. 30, 2025, in connection with Korean Patent Application No. 10-2021-7004205 [English instructions; two cited references; document as filed in Korean; and English translation of marked-up and clean claims], 94 pages.
Response, filed Nov. 7, 2024, to Office Action, dated Aug. 27, 2024, in connection with Korean Patent Application No. 10-2024-7014462 [English instructions; Response as filed in Korcan, including references cited; and English translation of marked up and clean claims], 466 pages.
Response, filed Oct. 16, 2024, to Examination Report, dated Mar. 20, 2024, in connection with New Zealand Patent Application No. 771198 [Response as filed, clean and marked up claims, and 4 references cited in response], 131 pages.
Response, filed Sep. 26, 2024, to Examiner's Report, dated May 28, 2024, in connection with Canadian Patent Application No. 3,131,017, 80 pages.
Notice of Allowance, dated Feb. 7, 2025, in connection with Canadian Patent Application No. 3,131,017, 1 page.
Response to Office Action, dated Jul. 17, 2024, in connection with Chinese Patent Application No. 202080031041.0 [English instructions; Response as filed in Chinese and received from foreign associate on Nov. 25, 2024; and English translation of pending claims], 52 pages.
Office Action, issued Feb. 6, 2025, in connection with Chinese Patent Application No. 202080031041.0 [English translation of the Office Action and document as issued in Chinese], 5 pages.
Response to Office Action, dated Feb. 6, 2025, in connection with Chinese Patent Application No. 202080031041.0 [English instructions; Response as filed in Chinese and received from foreign associate on Apr. 17, 2025; and English translation of pending claims], 74 pages.
Office Action, issued Apr. 23, 2025, in connection with Chinese Patent Application No. 202080031041.0 [English translation of the Office Action and document as issued in Chinese], 8 pages.
Response, filed Dec. 28, 2024, to Office Action, issued Jul. 19, 2023, in connection with Eurasian Patent Application No. 202100228 [English instructions and Response as filed in Russian], 115 pages.
Office Action, issued Jun. 10, 2025, in connection with Eurasian Patent Application No. 202100228 [English translation of Office Action, and document as issued in Russian], 19 pages.
Communication pursuant to Rule 164(2)(b) and Article 94(3) EPC, dated May 13, 2025, issued in connection with European Patent Application No. 20 718 416.9, 12 pages.
Response, filed May 7, 2025, to Office Action, dated Nov. 5, 2024, issued in connection with Japanese Patent Application No. 2021-549951 [English instructions, documents as filed in Japanese, and English translation of claims], 104 pages.
Office Action, mailed May 26, 2025, issued in connection with Korean Patent Application No. 10-2021-7030754 [English translation, and document as issued in Korean], 12 pages.
Office Action, issued Feb. 10, 2025, in connection with U.S. Appl. No. 17/320,200, 28 pages.
Response, filed Jun. 10, 2025, to Office Action, issued Feb. 10, 2025, in connection with U.S. Appl. No. 17/320,200 [Response as filed including referenced article], 75 pages.
Office Action, issued Jan. 13, 2025, in connection with U.S. Appl. No. 17/590,700, 20 pages.
Examiner's Report, dated May 13, 2025, in connection with Australian Patent Application No. 2020382614, 6 pages.
Response, filed Dec. 20, 2024, to Examiner's Report, dated Aug. 22, 2024, in connection with Canadian Patent Application No. 3,161,450 [Response as filed with reference cited], 122 pages.
Office Action, dated Feb. 28, 2025, in connection with Chinese Patent Application No. 202080093356.8 [English translation of the Action; and document as issued in Chinese], 11 pages.
Response to Office Action, dated Feb. 28, 2025, in connection with Chinese Patent Application No. 202080093356.8 [English instructions; and Response as filed in Chinese and English translation of pending claims as received on Jun. 27, 2025], 100 pages.
Office Action, dated Nov. 29, 2023, in connection with Eurasian Patent Application No. 202200057 [English translation, and document as issued in Russian], 11 pages.
Response, filed Jun. 30, 2025, to Office Action, dated Nov. 29, 2023, in connection with Eurasian Patent Application No. 202200057 [English instructions; Response as filed in Russian; and English translation of pending claims], 117 pages.
Communication pursuant to Rule 164(2)(b) and Article 94(3) EPC, dated May 30, 2025, issued in connection with European Patent Application No. 20 820 673.0, 11 pages.
Office Action, mailed on Oct. 29, 2024, in connection with Japanese Patent Application No. 2022-527167 [English summary, English translation of action, and document as issued in Japanese], 16 pages.
Response, filed Apr. 28, 2025, and Petition, filed May 21, 2025, in connection with Japanese Patent Application No. 2022-527167 [English instructions, English reporting letter, response as filed in Japanese], 301 pages.
Examination Report, dated Jul. 8, 2025, in connection with Australian Patent Application No. 2024200578, 4 pages.
Response to Office Action, dated Apr. 23, 2025, in connection with Chinese Patent Application No. 202080031041.0 [English instructions; Response as filed in Chinese; and English translation of pending claims as received on Jul. 25, 2025], 85 pages.
Response, filed Jul. 14, 2025, to Office Action, issued Jan. 13, 2025, in connection with U.S. Appl. No. 17/590,700, 47 pages.
Office Action, mailed on Jul. 1, 2025, in connection with Japanese Patent Application No. 2022-527167 [Summary of the Office Action, English translation of action, and document as issued in Japanese], 13 pages.
Decision of Rejection, dated Aug. 5, 2025, issued in connection with Japanese Patent Application No. 2021-549951 [English summary, machine-generated English translation, and document as issued in Japanese], 17 pages.
Notice of Final Rejection, dated Aug. 27, 2025, in connection with Korean Patent Application No. 10-2024-7014462 [English summary; machine-generated English translation of the Office Action; and Document as issued in Korean], 17 pages.
Response, filed Aug. 15, 2025, to Office Action, mailed May 26, 2025, issued in connection with Korean Patent Application No. 10-2021-7030754 [English instructions; document as filed in Korean; and English translation of marked up and clean claims], 223 pages.
Office Action, dated Jul. 25, 2025, in connection with Chinese Patent Application No. 202080093356.8 [English translation of the Action; and document as issued in Chinese], 16 pages.
Office Action, issued Aug. 26, 2025, in connection with Korean Patent Application No. 10-2022-7019261 [machine-generated English translation of Action, and document as issued in Korean], 14 pages.
Search Report and Written Opinion, issued Aug. 6, 2025, in connection with Singapore Patent Application No. 11202204828U, 14 pages.
Office Action, mailed Jul. 29, 2025, in connection with Japanese Patent Application No. 2023-510443 [Office Action Summary in English; English translation of the Office Action, and document as issued in Japanese], 31 pages.
Decision to Grant, dated Aug. 27, 2025, in connection with Korean Patent Application No. 10-2021-7004205 [English translation of Office Action; and Document as issued in Korean], 4 pages.
Office Action, dated Aug. 12, 2025, issued in connection with Israeli Patent Application No. 285608, 5 pages.

(56) References Cited

OTHER PUBLICATIONS

Office Action, dated May 16, 2023, in connection with Japanese Patent Application No. 2022-063218 [English summary of Office Action, English translation of Office Action, and original document as issued in Japanese], 11 pages.
Office Action, mailed Jan. 16, 2024, in connection with Japanese Patent Application No. 2023-194108 [English summary of Office Action, English translation of Office Action, and original document as issued in Japanese], 9 pages.
Letter/Written Disclosure of the Supplemental Information Disclosure Statement for the above-referenced application, filed herewith on May 4, 2026, 3 pages.
Communication pursuant to Article 94(3) EPC, dated Apr. 8, 2026, issued in connection with European Patent Application No. 20 718 416.9 [D2 = WO 2018/129404], 6 pages.
Office Action, dated Apr. 8, 2026, in connection with New Zealand Patent Application No. 779045, 2 pages.
Notice of Acceptance, dated Apr. 29, 2026, in connection with New Zealand Patent Application No. 779045, 2 pages.
Letter/Written Disclosure of the Supplemental Information Disclosure Statement for the above-referenced application, filed herewith on Apr. 2, 2026, 2 pages.
Corr et al., "Listeria monocytogenes infection in the face of innate immunity," Cellular Microbiology 11(5):703-9 (2009).
Crull et al., "Insights into tumor colonization of *Salmonella enterica serovar Typhimurium*," Doctoral dissertation, Hannover, Med. Hochsch (2011), 123 pages.
Kaimala et al., "Attenuated Bacteria as Immunotherapeutic Tools for Cancer Treatment," Front. Oncol. 8:136 (2018), 9 pages.
Kong et al., "Phosphate groups of lipid A are essential for *Salmonella enterica serovar Typhimurium* virulence and affect innate and adaptive immunity," Infection and immunity 80(9):3215-24 (2012).
Liu et al., "Construction of *Escherichia coli* Mutant with Decreased Endotoxic Activity by Modifying Lipid A Structure, " Mar. Drugs 13:3388-3406 (2015).
Machine-generated English language translation of Chinese Publication No. CN 108795832 A, published on Nov. 13, 2018, 28 pages.
Machine-generated English language translation of Japanese Patent Application No. 2006-115912, published as Japanese Pub. No. 2007-306911, 30 pages.
Wood and Paterson, "Attenuated Listeria monocytogenes: a powerful and versatile vector for the future of tumor immunotherapy," Frontiers in cellular and infection microbiology 4:51 (2014).
Response, filed Oct. 31, 2025, to Examination Report, dated Jul. 8, 2025, in connection with Australian Patent Application No. 2024200578 [Response as filed with references cited], 126 pages.
Examiner's Report, dated Sep. 19, 2025, in connection with Canadian Patent Application No. 3,176,812, 7 pages.
Response, filed Jan. 19, 2026, to Examiner's Report, dated Sep. 19, 2025, in connection with Canadian Patent Application No. 3,176,812, 50 pages.
Response, filed Dec. 26, 2025, to Notice of Final Rejection, dated Aug. 27, 2025, in connection with Korean Patent Application No. 10-2024-7014462 [English instructions; Amendment and Response as filed in Korean, including references cited; and English translation of pending claims], 504 pages.
Response, filed Sep. 15, 2025, to Communication pursuant to Rule 164(2)(b) and Article 94(3) EPC, dated May 13, 2025, in connection with European Patent Application No. 20 718 416.9, 30 pages.
Response, filed Dec. 11, 2025, to Office Action, dated Aug. 12, 2025, issued in connection with Israeli Patent Application No. 285608, 31 pages.
Office Action, dated Feb. 5, 2026, issued in connection with Korean Patent Application No. 10-2021-7030754 [English translation, and document as issued in Korean], 11 pages.
Office Action, dated Nov. 24, 2025, issued in connection with Mexican Patent Application No. MX/a/2021/010273 [English translation of action, and document as issued in Spanish], 21 pages.
Office Action, dated Sep. 17, 2025, in connection with New Zealand Patent Application No. 779045, 5 pages.
Response, filed Mar. 12, 2026, to Office Action, dated Sep. 17, 2025, in connection with New Zealand Patent Application No. 779045, 579 pages.
Office Action, issued Sep. 26, 2025, in connection with U.S. Appl. No. 17/320,200, 27 pages.
Office Action, issued Dec. 10, 2025, in connection with U.S. Appl. No. 17/320,200, 25 pages.
Final Office Action, issued Nov. 6, 2025, in connection with U.S. Appl. No. 17/590,700, 19 pages.
Response, filed Feb. 6, 2026, to Final Office Action, issued Nov. 6, 2025, in connection with U.S. Appl. No. 17/590,700, 55 pages.
Advisory Action, issued Feb. 13, 2026, in connection with U.S. Appl. No. 17/590,700, 4 pages.
Response, filed Sep. 20, 2025, to Examiner's Report, dated May 13, 2025, in connection with Australian Patent Application No. 2020382614, 65 pages.
Examiner's Report, dated Sep. 25, 2025, in connection with Australian Patent Application No. 2020382614, 3 pages.
Response, filed Oct. 10, 2025, to Examiner's Report, dated Sep. 25, 2025, in connection with Australian Patent Application No. 2020382614, 41 pages.
Notice of Acceptance, dated Nov. 28, 2025, in connection with Australian Patent Application No. 2020382614, 3 pages.
Notice of Allowance, dated Oct. 15, 2025, in connection with Canadian Patent Application No. 3,177,479, 1 pagc.
Response to Office Action, dated Jul. 25, 2025, in connection with Chinese Patent Application No. 202080093356.8 [English instructions; and Reporting letter, Response as filed in Chinese, and English translation of pending claims as received on Feb. 3, 2026], 139 pages.
Supplementary Amendment, filed in connection with Chinese Patent Application No. 202080093356.8 [English reporting letter; Response as filed in Chinese; and English translation of pending claims as received on Feb. 24, 2026], 22 pages.
Office Action, dated Sep. 8, 2025, in connection with Eurasian Patent Application No. 202200057 [English translation, and document as issued in Russian], 15 pages.
Response, filed Feb. 9, 2026, to Office Action, dated Sep. 8, 2025, in connection with Eurasian Patent Application No. 202200057 [English instructions; Response as filed in Russian; and English translation of pending claims], 140 pages.
Response, filed Nov. 27, 2025, to Communication pursuant to Rule 164(2)(b) and Article 94(3) EPC, dated May 30, 2025, in connection with European Patent Application No. 20 820 673.0, 52 pages.
Extended European Search Report, dated Nov. 19, 2025, in connection with European Patent Application No. 25 169 541.7, 7 pages.
Office Action, dated Dec. 2, 2025, in connection with Japanese Patent Application No. 2025-184585 [Summary of the Office Action, English translation of action, and document as issued in Japanese], 18 pages.
Response, filed Jan. 5, 2026, to Search Report and Written Opinion, issued Aug. 6, 2025, in connection with Singapore Patent Application No. 11202204828U, 58 pages.
Response, filed Oct. 28, 2025, to Office Action, mailed Jul. 29, 2025, in connection with Japanese Patent Application No. 2023-510443 [English instructions; Response as filed in Japanese; and English translation of pending claims], 54 pages.
Decision of Rejection, issued Dec. 9, 2025, in connection with Japanese Patent Application No. 2023-510443 [Office Action Summary in English; English translation of the Office Action, and document as issued in Japanese], 25 pages.
Amendment and Request for Accelerated Examination, filed Mar. 5, 2026, in connection with Divisional Japanese Patent Application No. 2025-227194 [English instructions, documents as filed in Japanese, and English language version of claims as filed], 145 pages.
Amendment and Request for Continued Examination, filed Mar. 6, 2026, to Final Office Action, issued Nov. 6, 2025, and Advisory Action, issued Feb. 13, 2026, in connection with U.S. Appl. No. 17/590,700, 58 pages.
Office Action, issued Mar. 11, 2026, in connection with Korean Patent Application No. 10-2023-7008539 [Office Action Summary

(56) References Cited

OTHER PUBLICATIONS in English, English machine translation of the Office Action, and document as issued in Korean], 15 pages.
Certificate of Grant, dated Mar. 26, 2026, in connection with Australian Patent Application No. 2020382614, 1 page.
Office Action, issued Mar. 26, 2026, in connection with Brazilian Patent Application No. BR112021016728-5 [English translation of Office Action, and document as issued in Portuguese], 9 pages.
Letter/Written Disclosure of the Supplemental Information Disclosure Statement for the above-referenced application, filed herewith on Jun. 4, 2026, 5 pages.
Yu et al., "STING-mediated inflammation in Kupffer cells contributes to progression of nonalcoholic steatohepatitis," The Journal of clinical investigation 129(2):546-555 (2019).
Office Action, dated Apr. 13, 2026, and received by foreign associate on Apr. 22, 2026, issued in connection with Mexican Patent Application No. MX/a/2021/010273 [English translation of action, and document as issued in Spanish], 30 pages.
Written Opinion, dated May 15, 2026, in connection with Singapore Patent Application No. 11202108459Q, 8 pages.
Office Action, issued May 19, 2026, issued in connection with Divisional Japanese Patent Application No. 2025-227194 [English summary, machine-generated English translation, and document as issued in Japanese], 19 pages.
Notification of Readiness to Grant, issued May 14, 2026, in connection with Eurasian Patent Application No. 202100228 [English translation of Notification, and document as issued in Russian], 11 pages.
Letter/Written Disclosure of the Supplemental Information Disclosure Statement for the above-referenced application, filed herewith on Jul. 9, 2026, 3 pages.
Office Action, dated Jun. 17, 2026, issued in connection with Indian Patent Application No. 202117038731, 12 pages.

* cited by examiner

Human STING (SEQ ID NO:306) and Tasmanian devil STING (SEQ ID NO:331):

```
Human            1 MPHSSLHPSIPCPRGHGAQKAALVLLSACLVTLWGLGEPPEHTLRYLVLH    50
                   ||.|.||||||.|||.||||||.||||.|:..::.|||....||::|:.:
Tasmanian        1 MPRSHLHPSIPQPRGWGAQKAACVLLSLCMAAVYILGESAAFTLQWLLFY    50

Human           51 LASLQLGLLLNGVCSLAEELRHIHSRYRGSYWRTVRACLGCPLRRGALLL   100
                   ..::|:||||.|...|||||.||.||::||||:.::||:..|.:|.:|||
Tasmanian       51 FTTVQVGLLLKGAYCLAEELYHIQSRHQGSYWQAIQACIHYPFQRISLLL   100

Human          101 LSIYFYYSLPNAVGPPFTWMLALLGLSQALNILLGLKGLAPAEISAVCEK   150
                   ||.|||.:|.|...|..||..||||||.||:.:|||:.|..||||.||||
Tasmanian      101 LSGYFYVTLSNKPNPSLTWTFALLGLSHALSFILGLQNLTSAEISEVCEK   150

Human          151 GNFNVAHGLAWSYYIGYLRLILPELQARIRTYNQHYNNLLRGAVSQRLYI   200
                   .:.|||||||||||||||:||||.||.||:.|||...::||.....||:|
Tasmanian      151 RHLNVAHGLAWSYYIGYLKLILPGLQTRIQIYNQFNKDVLRSPEGHRLHI   200

Human          201 LLPLDCGVPDNLSMADPNIRFLDKLPQQTGDHAGIKDRVYSNSIYELLEN   250
                   |:||||.||||||.|||||:||.:|||...|.||||.|:|:||||::.|:
Tasmanian      201 LIPLDCSVPDNLSQADPNIQFLQELPQHKLDRAGIKGRIYTNSIYKISED   250

Human          251 GQRAGTCVLEYATPLQTLFAMSQYSQAGFSREDRLEQAKLFCRTLEDILA   300
                   ||.|..||||:||||||||||||.::|||||||||||||||||||||||.
Tasmanian      251 GQPAEVCVLEFATPLQTLFAMSQDARAGFSREDRLEQAKLFCRTLEDILE   300

Human          301 DAPESQNNCRLIAYQEPADD--SSFSLSQEVLRHLRQEEKEEVTVGSLKT   348
                   ||||:::.|||:.||||.|.  |:||||:|:|||||||.:||..:|..:.
Tasmanian      301 DAPEARDCCRLVVYQEPEDKAVSNFSLSKEILRHLRQERQEEFAIGPKRA   350

Human          349 SAVPSTSTMSQEPELLISGMEKPLPLRTD-FS    379
                   ..|.::||:||||:|||||||:||.|||| |
Tasmanian      351 MTVTTSSTLSQEPQLLISGMEQPLSLRTDGF-    381
```

FIG. 1

Human STING (SEQ ID NO:306) and Marmoset STING (SEQ ID NO:341):

```
Human          1 MPHSSLHPSIPCPRGHGAQKAALVLLSACLVTLWGLGEPPEHTLRYLVLH   50
                 |||||||||||.|||||||:|||||||.||||||.|.|.||..||:||||
Marmoset       1 MPHSSLHPSIPHPRGHGAQEAALVLLSVCLVTLWWLREAPEDILRFLVLH   50

Human         51 LASLQLGLLLNGVCSLAEELRHIHSRYRGSYWRTVRACLGCPLRRGALLL  100
                 |||||||||||.:|||||||||:|:||:|||||.||||||||:|.||.||
Marmoset      51 LASLQLGLLLNRLCSLAEELRHVHTRYQGSYWRAVRACLGCPIRLGAQLL  100

Human        101 LSIYFYYSLPNAVGPPFTWMLALLGLSQALNILLGLKGLAPAEISAVCEK  150
                 ||||||..|||  |.||||||||||.||||||||||||||||||||||||
Marmoset     101 LSIYFYCFLPN--GRPFTWMLALLGFSQALNILLGLKGLAPAEISAVCEK  148

Human        151 GNFNVAHGLAWSYYIGYLRLILPELQARIRTYNQHYNNLLRGAVSQRLYI  200
                 .||||||||||||||||||||||..||||||||||.||:|||..||||||
Marmoset     149 RNFNVAHGLAWSYYIGYLRLILPGFQARIRTYNQHNNNVLRGPASQRLYI  198

Human        201 LLPLDCGVPDNLSMADPNIRFLDKLPQQTGDHAGIKDRVYSNSIYELLEN  250
                 |.|||||||||||.|||||||||||||:|.|.||||.|||:|||||||||
Marmoset     199 LFPLDCGVPDNLSTADPNIRFLDKLPQETIDRAGIKGRVYTNSIYELLEN  248

Human        251 GQRAGTCVLEYATPLQTLFAMSQYSQAGFSREDRLEQAKLFCRTLEDILA  300
                 |||||.||||||:|||||||||||.|||||||||||||||||||||||||
Marmoset     249 GQRAGACVLEYASPLQTLFAMSQYGQAGFSREDRLEQAKLFCRTLEDILA  298

Human        301 DAPESQNNCRLIAYQEPADDSSFSLSQEVLRHLRQEEKEEVTVGSLKTSA  350
                 ||||||||||||.|:||||.|||.||||||:||||||:|||||||||||.
Marmoset     299 DAPESQNNCRLIVYEEPADGSSFLLSQEVLQHLRQEEEEEVTVGSLKTSE  348

Human        351 VPSTSTMSQEPELLISGMEKPLPLRTDFS    379
                 |||||||||||||||||||||||||:|..
Marmoset     349 VPSTSTMSQEPELLISGMEKPLPLRSDLF    377
```

FIG. 2

Human STING (SEQ ID NO:306) and cattle STING (SEQ ID NO:342):

```
Human             1 MPHSSLHPSIPCPRGHGAQKAALVLLSACLVTLWGLGEPPEHTLRYLVLH    50
                    |||||||||||.|||..||||||||||||||.||||||||::||::||||
Cattle            1 MPHSSLHPSIPQPRGLRAQKAALVLLSACLVALWGLGEPPDYTLKWLVLH    50

Human            51 LASLQLGLLLNGVCSLAEELRHIHSRYRGSYWRTVRACLGCPLRRGALLL   100
                    |||.|:|||:.|:|||||||.|:||||.|||||.|||||...:|.|||||
Cattle           51 LASQQMGLLIKGICSLAEELCHVHSRYHGSYWRAVRACLCSSMRCGALLL   100

Human           101 LSIYFYYSLPNAVGPPFTWMLALLGLSQALNILLGLKGLAPAEISAVCEK   150
                    ||.|||.||||....|||||||||||||||||||||:||||||:||:|||
Cattle          101 LSCYFYCSLPNMADLPFTWMLALLGLSQALNILLGLQGLAPAEVSAICEK   150

Human           151 GNFNVAHGLAWSYYIGYLRLILPELQARIRTYNQHYNNLLRGAVSQRLYI   200
                    .||||||||||||||||||||||.|.|||:.|||.:||.|:||.|.||:|
Cattle          151 RNFNVAHGLAWSYYIGYLRLILPGLPARIQIYNQFHNNTLQGAGSHRLHI   200

Human           201 LLPLDCGVPDNLSMADPNIRFLDKLPQQTGDHAGIKDRVYSNSIYELLEN   250
                    |.||||||||:|::||||||||.:||||:.|.||||.|||:|||||||||
Cattle          201 LFPLDCGVPDDLNVADPNIRFLHELPQQSADRAGIKGRVYTNSIYELLEN   250

Human           251 GQRAGTCVLEYATPLQTLFAMSQYSQAGFSREDRLEQAKLFCRTLEDILA   300
                    |||||.|||||||||||||||||..:||||||||||||||||||||||||
Cattle          251 GQRAGVCVLEYATPLQTLFAMSQDGRAGFSREDRLEQAKLFCRTLEDILA   300

Human           301 DAPESQNNCRLIAYQEPADDSSFSLSQEVLRHLRQEEKEEVTVGSLKTSA   350
                    :|||||||||||.|||||:.||||||||:|:||||||: |||:||.:||.
Cattle          301 NAPESQNNCRLIVYQEPAEGSSFSLSQEILQHLRQEER-EVTMGSTETSV   349

Human           351 VPSTSTMSQEPELLISGMEKPLPLRTDFS   379
                    :|.:|.:||||||||||:|||||||:|..
Cattle          350 MPGSSVLSQEPELLISGLEKPLPLRSDVF   378
```

FIG. 3

Human STING (SEQ ID NO:306) and cat STING (SEQ ID NO:338):

```
Human     1 MPHSSLHPSIPCPRGHGAQKAALVLLSACLVTLWGLGEPPEHTLRYLVLH   50
            ||.:.||||||.|||.||||||||||:.||..||.|||.|:||||:||||
Cat       1 MPRTGLHPSIPRPRGMGAQKAALVLLAVCLAALWRLGESPDHTLRWLVLH   50

Human    51 LASLQLGLLLNGVCSLAEELRHIHSRYRGSYWRTVRACLGCPLRRGALLL  100
            |||||||||..|||.|.|||.|:||||:|||||.::||||.|:|.|||||
Cat      51 LASLQLGLLFTGVCRLTEELCRLHSRYQGSYWRAMKACLGSPVRSGALLL  100

Human   101 LSIYFYYSLPNAVGPPFTWMLALLGLSQALNILLGLKGLAPAEISAVCEK  150
            ||.|||.:|| :...|||||||||||||||||||.|:||||||:||||||
Cat     101 LSCYFYSTLP-STDLPFTWMLALLGLSQALNILLDLQGLAPAEVSAVCEK  149

Human   151 GNFNVAHGLAWSYYIGYLRLILPELQARIRTYNQHYNNLLRGAVSQRLYI  200
            .||||||||||||||||||||||.|.||:.|.||.:||:|||..|.||:|
Cat     150 KNFNVAHGLAWSYYIGYLRLILPGLPARVLTCNQLHNNILRGTGSHRLHI  199

Human   201 LLPLDCGVPDNLSMADPNIRFLDKLPQQTGDHAGIKDRVYSNSIYELLEN  250
            |.||||||||::|:||||||||.:||||:.|.||||.|||:||:|.||||
Cat     200 LFPLDCGVPDDMSVADPNIRFLYELPQQSADRAGIKGRVYTNSVYALLEN  249

Human   251 GQRAGTCVLEYATPLQTLFAMSQYSQAGFSREDRLEQAKLFCRTLEDILA  300
            ||:||.|||||||||||||||||..:|||||||||||||||||.||||||
Cat     250 GQQAGICVLEYATPLQTLFAMSQDGRAGFSREDRLEQAKLFCRILEDILA  299

Human   301 DAPESQNNCRLIAYQEPADDSSFSLSQEVLRHLRQEEKEEVTVGSLKTSA  350
            |.||.|||||||.||||.:.|:||||||:||||||||: ||||||:.||.
Cat     300 DTPECQNNCRLIVYQEPEEGSNFSLSQEILRHLRQEER-EVTVGSVGTSM  348

Human   351 VPSTSTMSQEPELLISGMEKPLPLRTDFS   379
            |.:.|.:||||.|||||||:|||||||..
Cat     349 VRNPSVLSQEPNLLISGMEQPLPLRTDVF   377
```

FIG. 4

Human STING (SEQ ID NO:306) and ostrich STING (SEQ ID NO:343):

```
Human             1 MPHSSLHPS------IPCPRGHGAQKAALVLLSACLVTLWGLGEPPEHTL    44
                    |.|.|..||      ||..|...||.||.|||:.|...|:..|||..|..
Ostrich           1 MAHESGTPSNPATPLIPKAREGRAQHAAYVLLALCAAALYLAGEPVVHIA    50

Human            45 RYLVLHLASLQLGLLLNGVCSLAEELRHIHSRYRGSYWRTVRACLGCPLR    94
                    |....|..:||:|.||.|:|.|.||:.|:.:|:|||:.|.:.|||  .||
Ostrich          51 RSFTSHFVALQIGALLKGICYLVEEIFHLETRHRGSFRRALSACL--HLR    98

Human            95 -RGALLLLSIYFYYSLPNAVGPPFTWMLALLGLSQALNILLGLKGLAPAE   143
                     ...|||:....|.:|.:....|....|.|..|.|.|.:.|||...:..|
Ostrich          99 WHVTLLLVCGSAYVALLDGDEQPLGLHLGLACLCQLLILALGLHKPSAVE   148

Human           144 ISAVCEKGNFNVAHGLAWSYYIGYLRLILPELQARIRTYNQHYNNLLRGA   193
                    ||.:.|:...|||||||||||:|||:::||.|:..:....:...|:|...
Ostrich         149 ISEMSERSKQNVAHGLAWSYYVGYLKIVLPRLKESMENIGRTNPNMLAHK   198

Human           194 VSQRLYILLPLDCGVPDNLSMADPNIRFLDKLPQQTGDHAGIKDRVYSNS   243
                    .:.:|:||:||.|.:.|:|..||.||::...||:.|...||.|.|||.|:
Ostrich         199 ETWKLHILVPLSCNICDDLEKADSNIQYAMDLPETTLTRAGTKKRVYRNT   248

Human           244 IYELLENGQRAGTCVLEYATPLQTLFAMSQYSQAGFSREDRLEQAKLFCR   293
                    :|: :::..:...||:|||||||:|:||||...|.||||||:||||||.|
Ostrich         249 LYK-IKDEDKFRFCVVEYATPLQSLYAMSQDECAAFSREDRIEQAKLFYR   297

Human           294 TLEDILADAPESQNNCRLIAYQEPADDSSFSLSQEVLRHLRQEEKEEVTV   343
                    |||:||..|.|.....|||.|:|..:..:..||:|:||||:|:.:||.||
Ostrich         298 TLEEILQSAKECAGTYRLIVYEESGEAETHFLSREILRHLQQQRQEEYTV   347

Human           344 --GSLKTSAVPSTSTMSQEPELLISGMEKPLPLRTDFS   379
                      |:|          .|.:..|.||..:.|.|||:|..
Ostrich         348 CDGTL----------CSTDLSLQISESDLPQPLRSDCL   375
```

FIG. 5

Human STING (SEQ ID NO:306) and crested ibis STING (SEQ ID NO:344):

```
Human        1 ----MPHSSLHPS---IPCPRGHGAQKAALVLLSACLVTLWGLGEPPEHTL    44
                   .|....||:   ||..||..||.|..:||:.|...|:..|||...:.
Crested      1 MSQEPQWLSHPTALLIPKARGGRAQHAVYLLLALCAAVLYLAGEPLVPSA    50

Human       45 RYLVLHLASLQLGLLLNGVCSLAEELRHIHSRYRGSYWRTVRACLGCPLR    94
               |.|:.|..:||:|:||.|.|.||||:.|:.||:.||:||.:.||.  |||
Crested     51 RSLISHFMALQIGVLLKGTCYLAEEIFHLQSRHHGSFWRALSACF--PLR    98

Human       95 RGALLLLSIYFYYSLPNAVGPPFTWMLALLGLSQALNILLGLKGLAPAEI   144
               ...|:||....|......|.|....|.|..|.|.|.:.|||...:..|:
Crested     99 WHGLMLLVCGSAYVALLEDGQPLGLHLGLASLCQLLILALGLHKPSAVEM   148

Human      145 SAVCEKGNFNVAHGLAWSYYIGYLRLILPELQARIRTYNQHYNNLLRGAV   194
               |.:.|:...|||||||||||:|||:::||.::..:..:::...|:|....
Crested    149 SEMSERSKQNVAHGLAWSYYVGYLKIVLPRVKKSMEEFSRANPNVLARRE   198

Human      195 SQRLYILLPLDCGVPDNLSMADPNIRFLDKLPQQTGDHAGIKDRVYSNSI   244
               :.:|:||:||.|.|.|:|..||.||::|..||:.|...||.|.|||.:|:
Crested    199 TWKLHILVPLSCDVYDDLEKADSNIQYLMDLPETTLTRAGTKKRVYKHSL   248

Human      245 YELLENGQRAGTCVLEYATPLQTLFAMSQYSQAGFSREDRLEQAKLFCRT   294
               |.:.:.|.:...|.:|||||||:|:||||...|.|||||||||||||.||
Crested    249 YTIRDEGNKLWHCAVEYATPLQSLYAMSQDEYAAFSREDRLEQAKLFYRT   298

Human      295 LEDILADAPESQNNCRLIAYQEPADDSSFSLSQEVLRHLRQEEKEEVTVG   344
               ||:||..:.|.....|||.|:|..:..:.|||:::|.||||:..||.||.
Crested    299 LEEILKGSKECAGTYRLIVYEESGEAETHSLSRDILWHLRQQCHEEYTVY   348

Human      345 SLKTSAVPSTSTMSQEPELLISGMEKPLPLRTDFS    379
               .......|||:..|.|..|.||..:.|.|||:|.
Crested    349 EGNQPHNPSTTLHSTELNLQISESDLPQPLRSDC-    382
```

FIG. 6

Human STING (SEQ ID NO:306) and coelacanth STING (SEQ ID NO:345):

```
Human            1 MPHSSLHPSIPCPRGHGAQKAALVLLSACLVTLWGLGEPPEHTLRYLVLH   50
                   ....::...||.|||:.|.:.|..:::..|:.||......::.|..:.||
Coelacanth       1 FGLQNMSAIIPQPRGNRANQMAYFIITVILMLLWIFRNIMDNVLEVIALH   50

Human           51 LASLQLGLLLNGVCSLAEELRHIHSRYRGSYWRTVRACLGCPLRRGALLL  100
                   :..||...::.|:|:.|||:.|:..||.||||:.:.|||.........::
Coelacanth      51 ILLLQGAAIMKGICNFAEEVNHVQPRYGGSYWKALEACLNLSKYDVMKIV  100

Human          101 LS--IYFYYSLPNAVGPPFTWMLALL--GLSQALNILLGLKGLAPAEISA  146
                   .:  :::::|....|    .|.|.||  .|...||.:||:...:|.|:|.
Coelacanth     101 FAGVLWWHFSSSLFV----VWFLHLLVSCLCHLLNNVLGVLKPSPVEVSE  146

Human          147 VCEKGNFNVAHGLAWSYYIGYLRLILPELQARIRTYNQHYNNLLRGAVSQ  196
                   :.|:....||||||||||:|||:|:||||:.||::||..:.|||:....:.
Coelacanth     147 IYERNRIGVAHGLAWSYYLGYLKLVLPELEDRIKSYNVSHGNLLKHKETW  196

Human          197 RLYILLPLDCGVPDNLSMADPNIRFLDKLPQQTGDHAGIKDRVYSNSIYE  246
                   ||:|||||.|.:.|||:..|.||.|||.|.:...:.||||.|.|.:|:|:
Coelacanth     197 RLHILLPLSCSIFDNLADVDSNIEFLDNLSELQINRAGIKGRSYKHSLYQ  246

Human          247 LLENGQRAGTCVLEYATPLQTLFAMSQYSQAGFSREDRLEQAKLFCRTLE  296
                   :|:..:|...|:|||||||::|..||:.:.|.|::||||||.|||.|||:
Coelacanth     247 VLDEDKRPHYCILEYATPLKSLLEMSKEASAEFTKEDRLEQTKLFYRTLK  296

Human          297 DILADAPESQNNCRLIAY--QEPADDSSFSLSQEVLRHLRQEEKEEVTVG  344
                   |||.::.|.:...||:.|  :|.:..|.| ||:|:||||.|::|||..:.
Coelacanth     297 DILDNSQECRGRFRLVIYDGREDSGKSHF-LSKELLRHLNQQQKEEYFMS  345

Human          345 SLKTSAVPSTSTMSQEPELLISGMEKPLPLRTDFS    379
                   ........|||.:|.||:|:||..:.|..|:....
Coelacanth     346 EQTQPNSSSTSCLSTEPQLMISDTDAPHTLKRQVC    380
```

FIG. 7

Human STING (SEQ ID NO:306) and zebrafish STING (SEQ ID NO:330):

```
Human            1 ---------MPHSSLHPSIPCPRGHGAQKAALVLLSACLVTLWGLGEPPE     41
                            :|.:.....:.|..|.|    .|.|..|.|:.......|
Zebrafish        1 MSVMGEDALVPRARSRLPVMCAAGLG----FLTLAVAWLLDSDKFSE---     43

Human           42 HTLRYLVLHLASLQLGLLLNG----VCSLAEELR-HIHSRYRGSYWRTVR     86
                           ....:..||:|..    :|.|||||. |...||.|.......|
Zebrafish       44 --------RAGIIAFGLMLERFIYCICLLAEELLFHSRQRYHGRMSEIFR     85

Human           87 ACLGCPLRRGA--LLLLSIYFYYSLPNAVGPPFTWMLALLGLSQAL----    130
                   ||.     ||:  |.:.:|:.              ||.|.|:|.::
Zebrafish       86 ACF-----RGSGILGMCAIFL--------------MLMLGGVSFSVKQWS    116

Human          131 --NIL---------LGLKGLAPAEISAVCEKGNFNVAHGLAWSYYIGYLR    169
                     |::         ||:.|.||.|||.:||....|||||||||:|||||:
Zebrafish      117 HFNLMCAGYMLLNSLGVLGPAPVEISEICEAKKMNVAHGLAWSFYIGYLK    166

Human          170 LILPELQARIRTYNQHYNNLLRGAVSQRLYILLPLDCGVPDNLSMADPNI    219
                   .:||.|:..:|.|::.      ....|.||:|||||:..||......|.|:
Zebrafish      167 FLLPALEVNVREYSRR-----ERLSSPRLHILLPLNARVPSKPEEEDTNV    211

Human          220 RFLDKLPQQTGDHAGIKDRVYSNSIYELLENGQRAGTCVLEYATPLQTLF    269
                   .|.:.||....|.||::.|.|:||:|::..|.: ..:|:||||||||.||:
Zebrafish      212 VFHENLPDLKLDRAGVRKRSYTNSVYKITHNNE-TFSCILEYATPLLTLY    260

Human          270 AMSQYSQAGFSREDRLEQAKLFCRTLEDILADAPESQNNCRLIAYQEPAD    319
                   .|||.|.|||...:|.:|..||.|||..||.::.|.:|..|||...:...
Zebrafish      261 QMSQESSAGFGERERKQQVLLFYRTLSQILDNSLECRNRYRLILLNDEHT    310

Human          320 DSSFSLSQEVLRHLRQEE--------------KEEVTVGSLKTSAVPST-    354
                   .....||:|:.::|:|::              .||..||:. ..|:.:|
Zebrafish      311 GDPHYLSRELFQNLKQQDGEIFMDPTNEVHPVPEEGPVGNC-NGALQATF    359

Human          355 --STMSQEPELLISGMEKPLPLR------TDFS---------    379
                     ..||.||.|:.|   :|..||      ||:.
Zebrafish      360 HEEPMSDEPTLMFS---RPQSLRSEPVETTDYFNPSSAMKQN    398
```

FIG. 8

Human STING (SEQ ID NO:305) and boar STING (SEQ ID NO:347):

```
Human              1 MPHSSLHPSIPCPRGHGAQKAALVLLSACLVTLWGLGEPPEHTLRYLVLH    50
                     ||:||||||||.|||..||.||||||.||||.||||||.||:|||:||||
Boar               1 MPYSSLHPSIPQPRGLRAQVAALVLLGACLVALWGLGELPEYTLRWLVLH    50

Human             51 LASLQLGLLLNGVCSLAEELRHIHSRYRGSYWRTVRACLGCPLRRGALLL   100
                     |||.|:|||:.|:|||||||.|:||||:.||||..|||||||:|.|||||
Boar              51 LASQQIGLLVKGLCSLAEELCHVHSRYQSSYWRAARACLGCPIRCGALLL   100

Human            101 LSIYFYYSLPNAVGPPFTWMLALLGLSQALNILLGLKGLAPAEISAVCEK   150
                     ||.|||:|:.:..|.|..||||||||||||||||||:.|||||:||:|||
Boar             101 LSCYFYFSIRDKAGLPLPWMLALLGLSQALNILLGLQHLAPAEVSAICEK   150

Human            151 GNFNVAHGLAWSYYIGYLRLILPELQARIRTYNQHYNNLLRGAVSQRLYI   200
                     .||||||||||||||||||||||.|:|||:.|||.:.|:|.|..:.||:|
Boar             151 RNFNVAHGLAWSYYIGYLRLILPGLRARIQAYNQRHKNVLGGIGNHRLHI   200

Human            201 LLPLDCGVPDNLSMADPNIRFLDKLPQQTGDRAGIKDRVYSNSIYELLEN   250
                     |.||||||||:||:||||||||.:||||:.||||||.|||:|||||||||
Boar             201 LFPLDCGVPDDLSVADPNIRFLHELPQQSADRAGIKGRVYTNSIYELLEN   250

Human            251 GQRAGTCVLEYATPLQTLFAMSQYSQAGFSREDRLEQAKLFCRTLEDILA   300
                     ||.||.|||.|||||||||||||..:||||||||||||||||||||||||
Boar             251 GQPAGVCVLGYATPLQTLFAMSQDGRAGFSREDRLEQAKLFCRTLEDILA   300

Human            301 DAPESQNNCRLIAYQEPADDSSFSLSQEVLRHLRQEEKEEVTVGSLKTSA   350
                     ||||:|||||||.||||.:..|||||||:||||||||: |||:||.:||.
Boar             301 DAPEAQNNCRLIVYQEPTEGGSFSLSQEILRHLRQEER-EVTMGSAETSV   349

Human            351 VPSTSTMSQEPELLISGMEKPLPLRTDFS    379
                     ||::||:||||||||||||:|||||:|..
Boar             350 VPTSSTLSQEPELLISGMEQPLPLRSDIF    378
```

FIG. 9

Human STING (SEQ ID NO:305) and bat STING (SEQ ID NO:348):

```
Human          1 MPHSSLHPSIPCPRGHGAQK-AALVLLSACLVTLWGLGEPPEHTLRYLVL    49
                 |.|||||||:|.|||..|:. ||.|||..||..||..|:|.|:|||.|||
Bat            1 MSHSSLHPSVPRPRGRRARNIAAFVLLIVCLAALWLSGKPSEYTLRCLVL    50

Human         50 HLASLQLGLLLNGVCSLAEELRHIHSRYRGSYWRTVRACLGCPLRRGALL    99
                 ||||.|||||.|.||.|||||.||||||:|:|||.|||||.||:|.|.:|
Bat           51 HLASQQLGLLSNRVCYLAEELSHIHSRYQGNYWRAVRACLSCPIRFGVVL   100

Human        100 LLSIYFYYSLPNAVGPPFTWMLALLGLSQALNILLGLKGLAPAEISAVCE   149
                 |:|.:||.||||....|.|||||.||||:||||||||:||.|||:|.|||
Bat          101 LVSFFFYTSLPNIDDLPLTWMLAHLGLSEALNILLGLRGLTPAEVSTVCE   150

Human        150 KGNFNVAHGLAWSYYIGYLRLILPELQARIRTYNQHYNNLLRGAVSQRLY   199
                 :.:|||||||||||||||||||||.|:|||.||||.:.|.|:|..|.|||
Bat          151 QRHFNVAHGLAWSYYIGYLRLILPGLRARIHTYNQLHGNTLQGVGSHRLY   200

Human        200 ILLPLDCGVPDNLSMADPNIRFLDKLPQQTGDRAGIKDRVYSNSIYELLE   249
                 ||.||||||.|:||.||||||||.:||:|:.||||||:|||:||:|||||
Bat          201 ILFPLDCGVLDDLSAADPNIRFLRELPRQSSDRAGIKNRVYTNSVYELLE   250

Human        250 NGQRAGTCVLEYATPLQTLFAMSQYSQAGFSREDRLEQAKLFCRTLEDIL   299
                 .|:..|||||||||||||||||||.::||||:||||||||||||||.|||
Bat          251 KGKPVGTCVLEYATPLQTLFAMSQDARAGFSQEDRLEQAKLFCRTLADIL   300

Human        300 ADAPESQNNCRLIAYQEPADDSSFSLSQEVLRHLRQEEKEEVTVGSLKTS   349
                 ||.||||.:||||.||||.::|.|||||.:|:|||||||||||||::.|.
Bat          301 ADDPESQKSCRLIVYQEPTEESDFSLSQAILKHLRQEEKEEVTVGTVGTY   350

Human        350 AVPSTSTMSQEPELLISGMEKPLPLRTDFS   379
                 ..|.:||:.||||||||||::|||||||..
Bat          351 EAPGSSTLHQEPELLISGMDQPLPLRTDIF   380
```

FIG. 10

Human STING (SEQ ID NO:305) and manatee STING (SEQ ID NO:349):

```
Human          1 ---MPHSSLHPSIPCPRGHGAQKAALVLLSACLVTLWGLGEPPEHTLRYL     47
                    |||||||||||..||||.||||.|||.||||.||.|||||.|||::|
Manatee        1 MVEMPHSSLHPSIPRHRGHGIQKAAFVLLVACLVALWELGEPPGHTLQWL     50

Human         48 VLHLASLQLGLLLNGVCSLAEELRHIHSRYRGSYWRTVRACLGCPLRRGA     97
                 |..||||||||||..:|||||||.|:||||:.||||.||||:|||:||||
Manatee       51 VCQLASLQLGLLLKVICSLAEELCHVHSRYQSSYWRAVRACMGCPIRRGA    100

Human         98 LLLLSIYFYYSLPNAVGPPFTWMLALLGLSQALNILLGLKGLAPAEISAV    147
                 |||||.|||:..||....|.||.||||||.||:||||.|:||.||||||:
Manatee      101 LLLLSCYFYFCFPNMADLPLTWTLALLGLLQAMNILLSLQGLTPAEISAI    150

Human        148 CEKGNFNVAHGLAWSYYIGYLRLILPELQARIRTYNQHYNNLLRGAVSQR    197
                 |||.|.||||||||||||||||||||.||.|||.||..:||:|||..|||
Manatee      151 CEKRNLNVAHGLAWSYYIGYLRLILPGLQDRIRIYNLQHNNMLRGTGSQR    200

Human        198 LYILLPLDCGVPDNLSMADPNIRFLDKLPQQTGDRAGIKDRVYSNSIYEL    247
                 |:||.|||||||::||:||.|||||.|||||:.|.||||.|||:||:|:|
Manatee      201 LHILFPLDCGVPNDLSVADANIRFLQKLPQQSADCAGIKGRVYTNSVYQL    250

Human        248 LENGQRAGTCVLEYATPLQTLFAMSQYSQAGFSREDRLEQAKLFCRTLED    297
                 ||:||.||.|||||||||||||||||..:|||||||||||||||||||||
Manatee      251 LEHGQPAGICVLEYATPLQTLFAMSQDGRAGFSREDRLEQAKLFCRTLED    300

Human        298 ILADAPESQNNCRLIAYQEPADDSSFSLSQEVLRHLRQEEKEEVTVGSLK    347
                 |||||||.|||||||.|||.|:.||||||||:||||||||:|||||||:.
Manatee      301 ILADAPEYQNNCRLIVYQESAEGSSFSLSQEILRHLRQEEREEVTVGSVG    350

Human        348 TSAV-----PSTSTMSQEPELLISGMEKPLPLRTDFS    379
                 ||.|     ||||::||||:|||||||:|||||||..
Manatee      351 TSVVPSPSSPSTSSLSQEPKLLISGMEQPLPLRTDVF    387
```

FIG. 11

Human STING (SEQ ID NO:305) and ghost shark STING (SEQ ID NO:350):

```
Human          1 MPHSSLHPSIPCPRGHGAQKAALVLLS--ACLVTLWGLGEPPEHTLRYLV  48
                      :..|||.|||..|....|:|:|  |||..:.    .|::.::::|
GhostShark     1 -----MSDSIPRPRGKVATYVGLILMSGLACLYFML----TPDYHIKFIV  41

Human         49 LRLASLQL-----GLLLNGVCSLAEELRRIHSRYRGSYWRTVRACLGCPL  93
                 ..:|. ||      .|.|..:|...|||.|..:||:.|:.|.:.|.|...
GhostShark    42 QQVAQ-QLIVSFFALCLLRLCEFVEELGHKQTRYQNSWVRALNASLDWK-  89

Human         94 RRGALLLLSIYFYYSLPNAVGPPFTWMLALLGLSQALNI---------LL 134
                 :.|..||:|:.|.:.||......:     |:..:.|.:::         :.
GhostShark    90 KYGFCLLISLLFNWVLPYEKHMSY----AVPTVGQTISLTCFCVLFLKVF 135

Human        135 GLKGLAPAEISAVCEKGNFNVAHGLAWSYYIGYLRLILPELQARIRTYNQ 184
                 .|..|:||:||.:.|....||||||||||:|||:::||:|:.:|..|::
GhostShark   136 QLDVLSPAQISEISETNKCNVAHGLAWSYYLGYLKIVLPKLEEKINQYHR 185

Human        185 HYNNLLRGAVSQRLYILLPLDCGVPDNLSMADPNIRFLDKLPQQTGDRAG 234
                 .|.|:|: ...::||||:|..|.|.|.|...|.||.|...||:...||||
GhostShark   186 EYGNVLQ-QKGKKLYILIPFSCKVLDKLEKVDTNIVFYQNLPELLVDRAG 234

Human        235 IKDRVYSNSIYELL-ENGQRAGTCVLEYATPLQTLFAMSQYSQAGFSRED 283
                 ||.|.|.:|||.:. :..|:...|:||||||||::||.|:..|.|.||:|.
GhostShark   235 IKSRSYKHSIYLIYDQKKQQPHHCILEYATPLRSLFEMTNDSAAAFSKEQ 284

Human        284 RLEQAKLFCRTLEDILADAPESQNNCRLIAYQEPADDSSFS---LSQEVL 330
                 ||:||||||.|||:.||.:.:.||...:.|||.|.:..:.:...   :|:|:|
GhostShark   285 RLDQAKLFYRTLKSILNNVPEVTGSYRLIPYDDDLEGAELGPHFVSEEIL 334

Human        331 RHLRQEEKEEVTVGSLKTSAVPSTSTMSQEPELLISGMEKPLPLRTDFS 379
                 :|:|||..|....    :.|....|..||.||.|:||  :.|.|||:...
GhostShark   335 KHMRQELTEYPVA---EPSNANETDCMSSEPHLMIS--DDPKPLRSYCP 378
```

FIG. 12

Human STING (SEQ ID NO:305) and mouse STING (SEQ ID NO:351):

```
Human      1 MPHSSLHPSIPCPRGHGAQKAALVLLSACLVTLWGLGEPPEHTLRYLVLH     50
             ||:|:|||:||.||||.::..||:.|.|.|:.||...:||.|||:||.||
Mouse      1 MPYSNLHPAIPRPRGHRSKYVALIFLVASLMILWVAKDPPNHTLKYLALH     50

Human     51 LASLQLGLLLNGVCSLAEELRHIHSRYRGSYWRTVRACLGCPLRRGALLL    100
             |||.:|||||..:|.|||||.|:.|||:||||:.||||||||:...|::|
Mouse     51 LASHELGLLLKNLCCLAEELCHVQSRYQGSYWKAVRACLGCPIHCMAMIL    100

Human    101 LSIYFYYSLPNAVGPPFTWMLALLGLSQALNILLGLKGLAPAEISAVCEK    150
             ||.|||: |.|......:||..||.|.::|::||||:.|.|||:|||||:
Mouse    101 LSSYFYF-LQNTADIYLSWMFGLLVLYKSLSMLLGLQSLTPAEVSAVCEE    149

Human    151 GNFNVAHGLAWSYYIGYLRLILPELQARIRTYNQHYNNLLRGAVSQRLYI    200
             ...||||||||||||||||||||.||||||.:||.:||:|.||.|:||||
Mouse    150 KKLNVAHGLAWSYYIGYLRLILPGLQARIRMFNQLHNNMLSGAGSRRLYI    199

Human    201 LLPLDCGVPDNLSMADPNIRFLDKLPQQTGDRAGIKDRVYSNSIYELLEN    250
             |.|||||||||||:.||||||.|.||||..||||||:||||||:||:|||
Mouse    200 LFPLDCGVPDNLSVVDPNIRFRDMLPQQNIDRAGIKNRVYSNSVYEILEN    249

Human    251 GQRAGTCVLEYATPLQTLFAMSQYSQAGFSREDRLEQAKLFCRTLEDILA    300
             ||.||.|:|||||||||||||||.::||||||||||||||||||||:||.
Mouse    250 GQPAGVCILEYATPLQTLFAMSQDAKAGFSREDRLEQAKLFCRTLEEILE    299

Human    301 DAPESQNNCRLIAYQEPADDSSFSLSQEVLRHLRQEEKEEVTVGSLKTSA    350
             |.|||:||||||.||||.|.:|||||||||||:|||||||||:.:..||.
Mouse    300 DVPESRNNCRLIVYQEPTDGNSFSLSQEVLRHIRQEEKEEVTMNAPMTSV    349

Human    351 VPSTSTMSQEPELLISGMEKPLPLRTDFS    379
             .|..|.:||||.||||||::|||||||..
Mouse    350 APPPSVLSQEPRLLISGMDQPLPLRTDLI    378
```

FIG. 13

IMMUNOSTIMULATORY BACTERIA ENGINEERED TO COLONIZE TUMORS, TUMOR-RESIDENT IMMUNE CELLS, AND THE TUMOR MICROENVIRONMENT

RELATED APPLICATIONS

This application is continuation of U.S. application Ser. No. 16/824,500, filed Mar. 19, 2020, entitled "IMMUNOSTIMULATORY BACTERIA ENGINEERED TO COLONIZE TUMORS, TUMOR-RESIDENT IMMUNE CELLS, AND THE TUMOR MICROENVIRONMENT," to Applicant Actym Therapeutics, Inc., and inventors Christopher D. Thanos, Laura Hix Glickman, Justin Skoble, Alexandre Charles Michel Iannello, and Haixing Kehoe.

U.S. application Ser. No. 16/824,500 is a continuation of International PCT Application No. PCT/US2020/020240, filed on Feb. 27, 2020, entitled "IMMUNOSTIMULATORY BACTERIA ENGINEERED TO COLONIZE TUMORS, TUMOR-RESIDENT IMMUNE CELLS, AND THE TUMOR MICROENVIRONMENT," to Applicant Actym Therapeutics, Inc., and inventors Christopher D. Thanos, Laura Hix Glickman, Justin Skoble, Alexandre Charles Michel Iannello, and Haixing Kehoe, and claims the benefit of priority to each of U.S. Provisional Application Ser. No. 62/962,140, filed Jan. 16, 2020, entitled "IMMUNOSTIMULATORY BACTERIA ENGINEERED TO COLONIZE TUMORS, TUMOR-RESIDENT IMMUNE CELLS, AND THE TUMOR MICROENVIRONMENT," to Applicant Actym Therapeutics, Inc., and inventors Christopher D. Thanos, Laura Hix Glickman, Justin Skoble, Alexandre Charles Michel Iannello, and Haixing Kehoe; U.S. Provisional Application Ser. No. 62/934,478, filed Nov. 12, 2019, entitled "IMMUNOSTIMULATORY BACTERIA ENGINEERED TO COLONIZE TUMORS AND THE TUMOR MICROENVIRONMENT," to Applicant Actym Therapeutics, Inc., and inventors Christopher D. Thanos, Laura Hix Glickman, Justin Skoble, and Alexandre Charles Michel Iannello; U.S. Provisional Application Ser. No. 62/828,990, filed Apr. 3, 2019, entitled "*SALMONELLA* STRAINS ENGINEERED TO COLONIZE TUMORS AND THE TUMOR MICROENVIRONMENT," to Applicant Actym Therapeutics, Inc., and inventors Christopher D. Thanos, Laura Hix Glickman, Justin Skoble, and Alexandre Charles Michel Iannello; and U.S. Provisional Application Ser. No. 62/811,521, filed Feb. 27, 2019, entitled, "TUMOR-TARGETING MICROORGANISMS THAT PROMOTE IMMUNO-STIMULATION OF THE TUMOR MICROENVIRONMENT," to Applicant Actym Therapeutics, Inc., and inventors Christopher D. Thanos, Laura Hix Glickman, Justin Skoble, and Alexandre Charles Michel Iannello.

This application, thus, is a continuation of U.S. application Ser. No. 16/824,500, and of International PCT Application No. PCT/US2020/020240, and claims benefit of priority to each of U.S. Provisional Application Ser. Nos. 62/962,140, 62/934,478, 62/828,990, and 62/811,521.

Where permitted, the subject matter of each of these applications is incorporated by reference in its entirety. The immunostimulatory bacteria provided in each of these applications can be modified as described in this application, and such bacteria are incorporated by reference herein.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Jan. 11, 2022, is 603 kilobytes in size, and is titled 1706BSEQ001.txt.

BACKGROUND

Tumors have evolved a profoundly immunosuppressive environment. They initiate multiple mechanisms to evade immune surveillance, reprogram anti-tumor immune cells to suppress immunity, and continually mutate resistance to the latest cancer therapies (see, e.g., Mahoney et al. (2015) *Nat. Rev. Drug Discov.* 14(8):561-584). The field of cancer immunotherapy has made great strides, as evidenced by the clinical successes of anti-CTLA4, anti-PD-1 and anti-PD-L1 immune checkpoint antibodies (see, e.g., Buchbinder et al. (2015) *J. Clin. Invest.* 125: 3377-3383; Hodi et al. (2015) *J. Clin. Invest.* 125:3392-4000; and Chen et al. (2015) *J. Clin. Invest.* 125:3384-3391). Designing immunotherapies that overcome immune tolerance and escape, while limiting the autoimmune-related toxicities of current immunotherapies, challenges the field of immuno-oncology. Hence, additional and innovative immunotherapies and other therapies are needed.

SUMMARY

Provided are bacteria modified to be immunostimulatory for anti-cancer therapy. Immunostimulatory bacteria, as provided herein, provide a multi-faceted approach to anti-tumor therapy. Bacteria provide a platform in which there are numerous avenues for eliciting anti-tumor immunostimulatory activity. As provided herein, bacteria, such as species of *Salmonella*, are fine-tuned to have potent anti-tumor activity by increasing their ability to accumulate in or target tumors, tumor-resident-immune cells, and/or the tumor microenvironment (TME). This is achieved by modifications that, for example, alter the type of cells that they can infect (tropism), their toxicity, their ability to escape the immune system, such as escaping inactivation by complement, and/or the environments in which they can replicate. The immunostimulatory bacteria also can encode, for example, products that enhance or invoke an immune response and other therapeutic/anti-cancer products. The immunostimulatory bacteria provided herein, by virtue of their improved colonization of tumors/the tumor microenvironment/tumor-resident immune cells, and their resistance to complement and other anti-bacterial immune responses, can be administered systemically.

Bacteria by their nature stimulate the immune system; bacterial infection induces immune and inflammatory pathways and responses, some of which are desirable for anti-tumor treatment, and others, are undesirable. Modification of the bacteria by deleting or modifying genes and products that result in undesirable inflammatory responses, and adding or modifying genes that induce desirable immunostimulatory anti-tumor responses, improves the anti-tumor activity of the bacteria.

Bacteria accumulate in tumor cells and tissues, and by replicating therein can lyse cells. Bacteria migrate from the sites of administration and can accumulate in other (e.g., distal/metastatic) tumors and tumor cells to provide an abscopal effect. The bacteria provided herein are modified so that they preferentially infect and accumulate in tumor-resident immune cells, tumors, and the tumor microenvironment, and deliver their plasmids that encode the therapeutic anti-cancer proteins and products. Herein, these properties of that bacteria are exploited to produce demonstrably immunostimulatory bacteria with a plurality of anti-tumor activities and properties that can act individually and synergistically.

The genomes of the bacteria provided herein are modified to increase accumulation in tumors and in tumor-resident immune cells, and also in the tumor microenvironment. This is effected herein by deleting or disabling genes responsible for infection or invasion of non-tumor cells, such as epithelial cells, and/or decreasing the cytopathogenicity of the bacteria, particularly to immune cells and tumor-resident immune cells.

Upon accumulation in the tumor-resident immune cells, proteins encoded on plasmids under control of eukaryotic regulatory signals, are expressed, and secreted into the TME. Immunostimulatory bacteria provided herein encode proteins that have anti-cancer activity, such as by modulating the anti-tumor immune response. Bacteria provided herein encode proteins that lead to expression of type I interferon (IFN). Such proteins include STING (Stimulator of Interferon Genes) and other immunostimulatory proteins that are part of a cytosolic DNA/RNA sensor pathway leading to expression of type I IFN, and also variants of these proteins that increase expression of type I IFN or that result in constitutive expression of IFN. For example, the immunostimulatory proteins include constitutively active variants of cytosolic DNA/RNA sensors, such as those with gain-of-function mutations.

Provided are compositions, uses thereof and methods that modulate immune responses for the treatment of diseases, including for the treatment of cancer. The compositions contain immunostimulatory bacteria provided herein. Methods of treatment and uses of the bacteria for treatment also are provided. The subjects for treatment include humans and other primates, pets, such as dogs and cats, and other animals, such as horses, cows and other farm and zoo animals.

Provided are pharmaceutical compositions containing the immunostimulatory bacteria, and methods and uses thereof for treatment of diseases and disorders, particularly proliferative disorders, such as tumors, including solid tumors and hematologic malignancies.

Also provided are methods of inhibiting the growth or reducing the volume of a solid tumor by administering the immunostimulatory bacteria or pharmaceutical compositions or using the compositions for treatment. For example, provided are methods of administering or using a composition that contains, for a single dosage, an effective amount of an immunostimulatory bacterium, such as a *Salmonella* species, to a subject, such as a human patient, having a solid tumor cancer.

Provided are immunostimulatory bacteria that encode immunostimulatory proteins that are constitutively active proteins that stimulate or evoke expression of type I IFN. The immunostimulatory bacteria also can encode other anti-tumor therapeutics, such as RNAi, and cytokines and chemokines, and, other modifications of the bacteria and the plasmids described herein, can be combined in any desired combination.

Provided are immunostimulatory bacteria that have enhanced colonization of tumors, the tumor microenvironment and/or tumor-resident immune cells, and enhanced anti-tumor activity. The immunostimulatory bacteria are modified by deletion of genes encoding the flagella, and/or modification of the genes so that functional flagella are not produced, and/or deletion of pagP or modification of pagP to produce inactive PagP product. As a result, the immunostimulatory bacteria are flagellin$^-$ (fliC$^-$/fljB$^-$) and/or pagP$^-$. Alternatively, or additionally, the immunostimulatory bacteria can be pagP$^-$/msbB$^-$.

The immunostimulatory bacteria can be aspartate-semialdehyde dehydrogenase$^-$ (asd$^-$), such as by virtue of disruption or deletion of all or a portion of the endogenous gene encoding aspartate-semialdehyde dehydrogenase (asd), whereby the endogenous asd is not expressed. The immunostimulatory bacteria can be modified to encode aspartate-semialdehyde dehydrogenase (asd) on a plasmid under control of a bacterial promoter for growing the bacteria in vitro, so that bacteria will have limited replication in vivo.

The immunostimulatory bacteria optionally have additional genomic modifications so that the bacteria are adenosine or purine auxotrophs. The bacteria optionally are one or more of asd$^-$, purI$^-$ and msbB$^-$. The immunostimulatory bacteria, such as *Salmonella* species, are modified to encode immunostimulatory proteins that confer anti-tumor activity in the tumor microenvironment, and/or are modified so that the bacteria preferentially infect immune cells in the tumor microenvironment or tumor-resident immune cells and/or induce less cell death in immune cells than in other cells. Also provided are methods of inhibiting the growth or reducing the volume of a solid tumor by administering the immunostimulatory bacteria.

Provided are methods of increasing tumor colonization of an immunostimulatory bacterium, such as a *Salmonella* species, by modifying the genome of an immunostimulatory bacterium to be flagellin$^-$ (fliC$^-$/fljB$^-$), whereby flagella are not produced, and/or to be pagP$^-$. In particular, the bacteria are flagellin$^-$ adenosine auxotrophs, and also are asd$^-$. The bacteria that are flagellin$^-$ are derived from bacterial species that express flagella.

The bacteria also contain plasmids that encode therapeutic products, such as anti-tumor agents, proteins that increase the immune response of a subject, and/or proteins that lead to constitutive or increased expression of immune stimulating proteins, such as type I interferon (IFN), including interferon-β. This includes encoding proteins that stimulate the immune system as part of a pathway that results in type I IFN expression, and, in particular, by rendering such proteins constitutively active. The plasmids also can encode immunostimulatory proteins, such as cytokines, that increase the anti-tumor immune response in the subject. The bacteria contain plasmids that encode anti-cancer therapeutics, such as interfering RNA, including microRNA, shRNA, and siRNA, that are designed to suppress, inhibit, disrupt or otherwise silence immune checkpoint genes and products, and other targets that play a role in pathways that are immunosuppressive. The bacteria also can encode tumor antigens on the plasmids to stimulate the immune response against the tumors. The encoded proteins are expressed under the control of promoters recognized by eukaryotic, such as mammalian and animal, or viral, promoters. The bacteria can expresses one, two, or more of the therapeutic proteins/products, including combinations of the gain-of-function immunostimulatory proteins, and/or cytokines. These heterologous proteins are encoded on the plasmid under control of a promoter, such as an RNA polymerase II or III promoter, recognized by a eukaryotic host.

Provided are immunostimulatory bacteria containing a plasmid encoding a product under control of a eukaryotic promoter, where the genome of the immunostimulatory bacterium is modified whereby the bacterium is flagellin$^-$ (fliC$^-$/fljB$^-$) and/or pagP$^-$. The bacteria can be one or both of flagellin$^-$ (fliC$^-$/fljB$^-$) and pagP$^-$. These immunostimulatory bacteria exhibit increased tumor/tumor microenvironment and tumor-resident immune cell colonization, and have increased anti-tumor activity.

Also provided are immunostimulatory bacteria containing a plasmid encoding a therapeutic product under control of a eukaryotic promoter, where the genome of the immunostimulatory bacterium is modified whereby the bacterium is $pagP^-/msbB^-$. These bacteria also have increased colonization of tumors, tumor-resident immune cells, and the tumor microenvironment. Because of the resulting change in bacterial membranes and structure, the host immune response, such as complement activity, is altered so that the bacteria are not eliminated upon systemic administration. These bacteria also can be flagellin$^-$ ($fliC^-/fljB^-$) and can comprise other modifications as described herein, including modifications that alter the cells that they can infect, resulting in accumulation in the tumor microenvironment, tumors and tumor-resident immune cells. Hence, the immunostimulatory bacteria provided herein can be systemically administered and exhibit a high level of tumor/tumor microenvironment and/or tumor-resident immune cell colonization. The immunostimulatory bacteria can be $purI^-$ ($purM^-$), one or more of $asd^-$, and $msbB^-$, and one or both of flagellin$^-$ ($fliC^-/fljB^-$) and $pagP^-$.

The immunostimulatory bacteria can be one or more of $purI^-$ ($purM^-$), $msbB^-$, $purD^-$, flagellin$^-$ ($fliC^-/fljB^-$), $pagP^-$, $adrA^-$, $csgD^-$, $qseC^-$, $hilA^-$, $lppA^-$ and $lppB^-$, and particularly flagellin$^-$ ($fliC^-/fljB^-$) and/or $pagP^-$, and/or $msbB^-/pagP^-$. For example, the immunostimulatory bacteria can include mutations in the genome, such as deletions or disruptions that reduce toxicity or infectivity of non-immune cells in a host. For example, the immunostimulatory bacteria can be $pagP^-$. As another example, the immunostimulatory bacteria can be flagellin$^-$ ($fliC^-/fljB^-$), and can also be $pagP^-$. The bacteria can be modified so that they accumulate and express the therapeutic product(s) in tumor-resident immune cells and in the tumor microenvironment (TME), thereby delivering an immunotherapeutic anti-tumor product into the environment in which it has beneficial activity, and avoiding adverse or toxic side effects from expression in other cells/environments. The nucleic acids encoding the immunostimulatory protein(s)/therapeutic product(s) can be operatively linked for expression to nucleic acids encoding a secretory signal, whereby, upon expression, in a host, the immunostimulatory protein/therapeutic product is secreted into the tumor microenvironment.

As discussed above, the genome of the immunostimulatory bacteria also is modified so that the bacteria preferentially infect immune cells, such as tumor-resident immune cells, and/or the genome is modified so that the bacteria induce less cell death in tumor-resident immune cells (decreased pyroptosis) than the unmodified bacteria. As a result, the immunostimulatory bacteria accumulate, or accumulate to a greater extent than those without the modifications, in tumors or in the tumor microenvironment or in tumor-resident immune cells, to thereby deliver the immunostimulatory protein(s) and constitutively active variants thereof, and other therapeutic products, to the cell to stimulate or induce expression of type I interferon. The bacteria can be one or more of flagellin$^-$ ($fliC^-/fljB^-$), $pagP^-$, and $msbB^-$, and can include other such modifications as described herein.

The immunostimulatory bacteria can also be aspartate-semialdehyde dehydrogenase$^-$ ($asd^-$), such as by virtue of disruption or deletion of all or a portion of the endogenous gene encoding aspartate-semialdehyde dehydrogenase (asd), whereby endogenous asd is not expressed. These immunostimulatory bacteria can be modified to encode aspartate-semialdehyde dehydrogenase (asd) on the plasmid under control of a bacterial promoter so that the bacteria can be produced in vitro.

The immunostimulatory bacteria can be rendered auxotrophic for particular nutrients, that are rich or that accumulate in the tumor microenvironment, such as adenosine and adenine. Also, they can be modified to be auxotrophic for such nutrients to reduce or eliminate their ability to replicate. The inactivated/deleted bacterial genome genes can be complemented by providing them on a plasmid under the control of promoters recognized by the host.

Additionally, the genome of the immunostimulatory bacterium is modified so that it preferentially infects tumor-resident immune cells. This is achieved by deleting or disrupting bacterial genes that play a role in invasiveness or infectivity of the bacteria, and/or that play a role in inducing cell death. The bacteria are modified to preferentially infect tumor-resident immune cells, and/or to induce less cell death in such cells, than unmodified bacteria, or than in other cells that the bacteria can infect.

The immunostimulatory bacteria provided herein can include a modification of the bacterial genome, whereby the bacterium induces less cell death in tumor-resident immune cells; and/or a modification of the bacterial genome, whereby the bacterium accumulates more effectively in tumors, the TME, or tumor-resident immune cells. These immunostimulatory bacteria can be further modified so that the bacteria preferentially infect tumor-resident immune cells, and/or the genome of the immunostimulatory bacterium can be modified so that it induces less cell death in tumor-resident immune cells (decreases pyroptosis), whereby the immunostimulatory bacterium accumulates in tumors or in the tumor microenvironment or in tumor-resident immune cells, to thereby deliver a constitutively active immunostimulatory protein, or other therapeutic product(s), to the cell to stimulate or induce expression of type I IFN.

The immunostimulatory bacteria can include deletions or modifications of one or more genes or operons involved in SPI-1-dependent invasion (and/or SPI-2), whereby the immunostimulatory bacteria do not invade or infect epithelial cells. Exemplary of genes that can be deleted or inactivated are one or more of avrA, hilA, hilD, invA, invB, invC, invE, invF, invG, invH, invI, invJ, iacP, iagB, spaO, spaP, spaQ, spaR, spaS, orgA, orgB, orgC, prgH, prgI, prgJ, prgK, sicA, sicP, sipA, sipB, sipC, sipD, sirC, sopB, sopD, sopE, sopE2, sprB, and sptP. Elimination of the ability to infect epithelial cells also can be achieved by engineering the immunostimulatory bacteria herein to contain knockouts or deletions of genes encoding proteins involved in SPI-1-independent invasion, such as one or more of the genes selected from among rck, pagN, hlyE, pefI, srgD, srgA, srgB, and srgC. Similarly, the immunostimulatory bacteria can include deletions in genes and/or operons in SPI-2, for example, to engineer the bacteria to escape the *Salmonella*-containing vacuole (SCV). These genes include, for example, sifA, sseJ, sseL, sopD2, pipB2, sseF, sseG, spvB, and steA.

For example, the immunostimulatory bacteria can be modified to have reduced pathogenicity, whereby infection of epithelial and/or other non-immune cells is reduced, relative to the bacterium without the modification. These include modification of the type 3 secretion system (T3SS) or type 4 secretion system (T4SS), such as modification of the SPI-1 pathway or T3SS system of *Salmonella* as described and exemplified herein. The bacteria further can be modified to induce less cell death, such as by deletion or disruption of nucleic acids encoding PagP (lipid A palmitoyltransferase), which reduces virulence of the bacterium.

The genome of the immunostimulatory bacteria provided herein can be modified to increase or promote infection of immune cells, particularly immune cells in the tumor microenvironment, such as phagocytic cells. This includes reducing infection of non-immune cells, such as epithelial cells, or increasing infection of immune cells. The bacteria also can be modified to decrease pyroptosis in immune cells. Numerous modifications of the bacterial genome can do one or both of increasing infection of immune cells and decreasing pyroptosis. The immunostimulatory bacteria provided herein include such modifications, for example, deletions and/or disruptions of genes involved in the SPI-1 T3SS pathway, such as disruption or deletion of hilA, and/or disruption/deletion of genes encoding flagellin, rod protein (PrgJ), needle protein (PrgI) and QseC.

The therapeutic products encoded on the plasmids for expression in a eukaryotic, such as a human, host, are under control of eukaryotic regulatory sequences, including eukaryotic promoters, such as promoters recognized by RNA polymerase II or III. These include viral and mammalian RNA polymerase II promoters.

Exemplary viral promoters, include, but are not limited to, a cytomegalovirus (CMV) promoter, an SV40 promoter, an Epstein Barr virus (EBV) promoter, a herpes virus promoter, a respiratory syncytial virus (RSV) promoter, and an adenovirus promoter. Other RNA polymerase II promoters include, but are not limited to, an elongation factor-1 (EF-1) alpha promoter, or a UbC promoter (lentivirus), or a PGK (3-phosphoglycerate kinase) promoter, a synthetic MND promoter, and a synthetic promoter such as a CAGG (or CAG) promoter. The synthetic CAG promoter contains the cytomegalovirus (CMV) early enhancer element (C); the promoter, the first exon and the first intron of chicken beta-actin gene (A); and the splice acceptor of the rabbit beta-globin gene (G). MND is a synthetic promoter that contains the U3 region of a modified MoMuLV LTR with myeloproliferative sarcoma virus enhancer (murine leukemia virus-derived MND promoter (myeloproliferative sarcoma virus enhancer, negative control region deleted, dl587rev primer-binding site substituted); see, e.g., Li et al. (2010) *J. Neurosci. Methods* 189:56-64). Other strong regulatable or constitutive promoters can be used. Exemplary of the promoters are the EF-1alpha promoter, CMV, SV40, PGK, EIF4A1, CAG, and CD68 promoters. The regulatory sequences also include terminators, enhancers, secretory and other trafficking signals.

The plasmids included in the immunostimulatory bacteria can be present in low copy number or medium copy number, such as by selection of an origin of replication that results in medium-to-low copy number, such as a low copy number origin of replication. It is shown herein that the anti-tumor activity and other properties of the bacteria are improved when the plasmid is present in low to medium copy number, where medium copy number is less than 150 or less than about 150 and more than 20 or about 20 or is between 20 or 25 and 150, and low copy number is less than 25 or less than 20 or less than about 25 or less than about 20 copies.

The immunostimulatory bacteria provided herein include any of the strains and bacteria described in U.S. application Ser. No. 16/033,187, further modified to express an immunostimulatory protein and/or to preferentially infect and/or to be less toxic in immune cells in the tumor microenvironment, or in tumor-resident immune cells, as described and exemplified herein.

Encoded Therapeutic Proteins/Products

The immunostimulatory bacteria encode a therapeutic protein or product, on a plasmid in the bacterium, under control of a eukaryotic promoter, that, when expressed in a mammalian subject, confers or contributes to anti-tumor immunity in the tumor microenvironment.

Products encoded by the immunostimulatory bacteria include proteins that are part of a cytosolic DNA/RNA sensor pathway that leads to expression of type I interferon (IFN), and variants thereof. These include variant proteins with increased activity and variant proteins that result in constitutive expression of type I interferons. These also include proteins that naturally, or by mutation, have decreased signaling activity in pathways that lead to undesirable immune responses, but that have type I interferon stimulating activity and/or interferon-β stimulating activity comparable to or greater than the native human proteins. In particular, the immunostimulatory bacteria encode gain-of-function (GOF) variants of an immunostimulatory protein that, in unmodified form, is part of a cytosolic DNA/RNA sensor pathway that leads to expression of type I interferon (IFN). Exemplary are gain-of function, constitutively active variants of an immunostimulatory protein that, in humans, promotes or causes interferonopathies, where the genome of the immunostimulatory bacterium is modified so that the bacterium preferentially infects tumor-resident immune cells, and/or the genome of the immunostimulatory bacterium is modified so that it induces less cell death in tumor-resident immune cells (decreases pyroptosis), whereby the immunostimulatory bacterium accumulates in tumors or in the tumor microenvironment or in tumor-resident immune cells, to thereby deliver the constitutively active immunostimulatory protein to the cell to stimulate or induce expression of type I IFN. The variant can include a mutation that eliminates a phosphorylation site in the immunostimulatory protein, to thereby reduce nuclear factor kappa-light-chain-enhancer of activated B cell (NF-κB) signaling. These include, for example, STING, RIG-I, MDA-5, IRF-3, IRF-5, IRF-7, TRIM156, RIP1, Sec5, TRAF3, TRAF2, TRAF6, STAT1, LGP2, DDX3, DHX9, DDX1, DDX9, DDX21, DHX15, DHX33, DHX36, DDX60, and SNRNP200, and variants thereof, such as those expressed in interferonopathies and conservative variations thereof that have constitutive activity or increased activity. In some embodiments, these include proteins that induce type I IFN, such as STING, RIG-I, IRF-3, IRF-7, or MDA5, and variants thereof that have increased activity or constitutive activity, where the immunostimulatory protein is STING, RIG-I, IRF-3, IRF-7, or MDA5.

Hence, provided herein are immunostimulatory bacteria comprising a plasmid that contains heterologous nucleic acid encoding a gain-of-function variant of an immunostimulatory protein that, in unmodified form, is part of a cytosolic DNA/RNA sensor pathway that leads to expression of type I interferon (IFN). These gain-of-function proteins are encoded on a plasmid under control of eukaryotic regulatory signals, including promoters, and optionally other regulatory signals, such as enhancers, polyA and transcription terminators. The nucleic acids encoding the proteins/products on the plasmid can be multiplexed, whereby a plurality of products are encoded. Strategies for multigene co-expression include use of multiple promoters in a single vector, fusion proteins, proteolytic cleavage sites between genes, internal ribosome entry sites (IRES), and "self-cleaving" (ribosome skipping) 2A peptides. 2A peptides are 18-22 amino-acid (aa)-long viral oligopeptides that mediate "cleavage" of polypeptides during translation in eukaryotic cells. Thus, provided are plasmids that encode the therapeutic products on the plasmid under control of a single promoter by including 2A self-cleaving peptides between the coding portions, such as T2A, P2A, F2A, and E2A.

The unmodified forms of the immunostimulatory proteins are proteins in a signaling pathway that senses cytosolic DNA/RNA. They include those proteins that are modified with amino acid replacement(s) or deletions that increase activity and/or render the activity constitutive. Provided are immunostimulatory bacteria that contain a plasmid encoding a gain-of-function, constitutively active variant of an immunostimulatory protein. These gain-of-function proteins, include proteins in the signaling pathway that leads to expression of type I interferon, including proteins that, in humans, promote or cause interferonopathies, and gain-of-function mutants that are modified, having been selected, to result in constitutive expression of type I interferon. The immunostimulatory protein in its unmodified form is one that senses or interacts directly or indirectly as part of a signaling pathway with cytosolic nucleic acids, nucleotides, dinucleotides, or cyclic dinucleotides, to induce expression of type I interferon, and the variant protein induces expression of type I interferon in the absence of the sensing or interacting with the cytosolic nucleic acids, nucleotides, dinucleotides, or cyclic dinucleotides (CDNs). Included are gain-of-function variants that do not require cytosolic nucleic acid, nucleotides, dinucleotides, or cyclic dinucleotides to result in expression of a type I interferon. Exemplary of such proteins are STING, RIG-I, MDA-5, IRF-3, IRF-5, IRF-7, TRIM56, RIP1, Sec5, TRAF3, TRAF2, TRAF6, STAT1, LGP2, DDX3, DHX9, DDX1, DDX9, DDX21, DHX15, DHX33, DHX36, DDX60, and SNRNP200.

In these immunostimulatory bacteria, the encoded variant gain-of-function protein can be one that eliminates a phosphorylation site in the immunostimulatory protein to thereby reduce nuclear factor kappa-light-chain-enhancer of activated B cell (NF-κB) signaling. Alternatively, the bacteria can include one or more replacements of the amino acid serine (S) or threonine (T) at a phosphorylation site with aspartic acid (D), which is phosphomimetic, and results in increased or constitutive activity. Exemplary of the proteins in signaling pathways that result in type I interferon expression are STING, RIG-I, IRF-3, IRF-7 and MDA5. Described herein are exemplary mutations that result in gain-of-function activity for each of these proteins. Mutations include those in which the encoded immunostimulatory protein is a variant STING, RIG-I, IRF-3, IRF-7 or MDA5, in which one or more serine (S) or threonine residue(s) that is/are phosphorylated as a consequence of viral infection, is/are replaced with an aspartic acid (D), whereby the resulting variant is a phosphomimetic that constitutively induces type I interferon. For example, provided are immunostimulatory bacteria in which the immunostimulatory protein is IRF-3 that has one or more replacement(s) at residues at positions 385, 386, 396, 398, 402, 404 and 405, and the residues are replaced with aspartic acid residues; this includes IRF-3 that has the replacement S396D with reference to SEQ ID NO:312, and IRF-3 that comprises the mutations S396D/S398D/S402D/T404D/S405D with reference to SEQ ID NO:312. Other examples are immunostimulatory bacteria wherein the immunostimulatory protein is selected from among STING, MDA5, IRF-7 and RIG-I, in which the mutations are selected as follows: a) in STING, with reference to human STING of SEQ ID NOs: 305-309, one or more selected from among: S102P, V147L, V147M, N154S, V155M, G166E, C206Y, G207E, S102P/F279L, F279L, R281Q, R284G, R284S, R284M, R284K, R284T, R197A, D205A, R310A, R293A, T294A, E296A, R197A/D205A, S272A/Q273A, R310A/E316A, E316A, E316N, E316Q, S272A, R293A/T294A/E296A, D231A, R232A, K236A, Q273A, S358A/E360A/S366A, D231A/R232A/K236A/R238A, S358A, E360A, S366A, R238A, R375A, and S324A/S326A; b) in MDA5, with reference to SEQ ID NO:310, one or more of: T331I, T331R, A489T, R822Q, G821S, A946T, R337G, D393V, G495R, R720Q, R779H, R779C, L372F, and A452T; c) in RIG-I, with reference to SEQ ID NO:311, one or both of E373A and C268F; and d) in IRF-7, with reference to SEQ ID NO:313, one or more of: S477D/S479D, S475D/S477D/S479D, S475D/S476D/S477D/S479D/S483D/S487D and Δ247-467. Any of these replacements can be replaced with a conservative mutations in accord with the Table of Exemplary Conservative Amino Acid Substitutions below.

Also provided are delivery vehicles, such as exosomes, liposomes, oncolytic viruses, nanoparticles, the immunostimulatory bacteria, and other such vehicles, that contain nucleic acids encoding the gain-of-function proteins and other therapeutic products, as described above and elsewhere herein. For example, provided are delivery vehicles that contain nucleic acids, generally DNA encoding a gain-of-function immunostimulatory protein that is part of a signaling pathway that results in expression of type I interferon. The gain-of-function variants can render expression of type I interferon constitutive. For example, these variants include any discussed herein, such as a modified STING, where: the modifications in STING render its activity constitutive so that it does not require cGAMP (or other ligands/CDNs) for activity; modified STING is encoded by a modified TMEM173 gene; the modifications comprise insertions, deletions or replacements of amino acid(s); and the modified STING has enhanced immunostimulatory activity compared to the unmodified STING. These amino acid replacement(s) in STING, with reference to human STING of SEQ ID NOs: 305-309, include one or more selected from among: S102P, V147L, V147M, N154S, V155M, G166E, C206Y, G207E, S102P/F279L, F279L, R281Q, R284G, R284S, R284M, R284K, R284T, R197A, D205A, R310A, R293A, T294A, E296A, R197A/D205A, S272A/Q273A, R310A/E316A, E316A, E316N, E316Q, S272A, R293A/T294A/E296A, D231A, R232A, K236A, Q273A, S358A/E360A/S366A, D231A/R232A/K236A/R238A, S358A, E360A, S366A, R238A, R375A, and S324A/S326A.

The immunostimulatory bacteria provided herein also can contain a sequence of nucleotides encoding an immunostimulatory protein that, when expressed in a mammalian subject, confers or contributes to anti-tumor immunity in the tumor microenvironment; the immunostimulatory protein is encoded on a plasmid in the bacterium under control of a eukaryotic promoter. Exemplary promoters include, but are not limited to, an elongation factor-1 (EF1) alpha promoter, or a UbC promoter, or a PGK promoter, or a CAGG or CAG promoter.

The immunostimulatory bacterial also can encode an inhibitory RNA (RNAi) that, when expressed in a mammalian subject, confers or contributes to anti-tumor immunity. The RNAi is encoded on a plasmid in the bacterium under control of a eukaryotic promoter. The genome of the immunostimulatory bacterium is modified so that it induces less cell death in tumor-resident immune cells and/or so that it accumulates in tumor-resident immune cells and in the tumor microenvironment/tumors.

The immunostimulatory bacteria provided herein also can encode other immunostimulatory proteins. The immunostimulatory protein can be a cytokine, such as a chemokine. Exemplary of immunostimulatory proteins are IL-2, IL-7, IL-12p70 (IL-12p40+IL-12p35), IL-15, IL-15/IL-15R alpha chain complex, IL-36 gamma, IL-18, CXCL9, CXCL10, CXCL11, CCL3, CCL4, CCL5, proteins that are involved in or that effect or potentiate the recruitment/persistence of T cells, CD40, CD40 Ligand (CD40L), OX40, OX40 Ligand (OX40L), 4-1BB, 4-1BB Ligand (4-1BBL), members of the B7-CD28 family, and members of the tumor necrosis factor receptor (TNFR) superfamily. In some embodiments, these include, for example, IL-2, IL-7, IL-12p70 (IL-12p40+IL-12p35), IL-15, IL-23, IL-36 gamma, IL-2 that has attenuated binding to IL-2Ra, IL-15/IL-15R alpha chain complex, IL-18, IL-2 modified so that it does not bind to IL-2Ra, CXCL9, CXCL10, CXCL11, interferon-α, interferon-β, CCL3, CCL4, CCL5, proteins that are involved in or that effect or potentiate recruitment/persistence of T cells, CD40, CD40 Ligand, OX40, OX40 Ligand, 4-1BB, 4-1BB Ligand, members of the B7-CD28 family, TGF-beta polypeptide antagonists, and members of the tumor necrosis factor receptor (TNFR) superfamily.

The immunostimulatory bacteria can optionally include a sequence of nucleotides encoding inhibitory RNA (RNAi) that inhibits, suppresses or disrupts expression of an immune checkpoint. The RNAi can be encoded on a plasmid in the bacterium. The nucleotides encoding the immunostimulatory protein, and optionally an RNAi, can be on a plasmid present in low to medium copy number.

The immunostimulatory bacteria also can encode therapeutic products, such as RNAi or a CRISPR cassette that inhibits, suppresses or disrupts expression of an immune checkpoint or other target whose inhibition, suppression or disruption increases the anti-tumor immune response in a subject; the RNAi or CRISPR cassette is encoded on a plasmid in the bacterium. Other therapeutic products include, for example, antibodies that bind to immune checkpoints to inhibit their activities, such as, for example, anti-PD-1, anti-PD-L1 and anti-CTLA-4 antibodies.

RNAi includes all forms of double-stranded RNA that can be used to silence the expression of targeted nucleic acids. RNAi includes shRNA, siRNA and microRNA (miRNA). Any of these forms can be interchanged in the embodiments disclosed and described herein. In general, the RNAi is encoded on a plasmid in the bacterium. The plasmids can include other heterologous nucleic acids that encode products of interest that modulate or add activities or products to the bacterium, or other such products that can modulate the immune system of a subject to be treated with the bacterium. Bacterial genes also can be added, deleted or disrupted. These genes can encode products for growth and replication of the bacteria, or products that also modulate the immune response of the host to the bacteria.

Bacterial species include, but are not limited to, for example, strains of *Salmonella, Shigella, Listeria, E. coli*, and Bifidobacteriae. For example, species include *Shigella sonnei, Shigella flexneri, Shigella dysenteriae, Listeria monocytogenes, Salmonella typhi, Salmonella typhimurium, Salmonella gallinarum*, and *Salmonella enteritidis*.

Species include, for example, strains of *Salmonella, Shigella, E. coli*, Bifidobacteriae, *Rickettsia, Vibrio, Listeria, Klebsiella, Bordetella, Neisseria, Aeromonas, Francisella, Cholera, Corynebacterium, Citrobacter, Chlamydia, Haemophilus, Brucella, Mycobacterium, Mycoplasma, Legionella, Rhodococcus, Pseudomonas, Helicobacter, Bacillus*, and *Erysipelothrix*, or an attenuated strain thereof or a modified strain thereof of any of the preceding list of bacterial strains.

Other suitable bacterial species include *Rickettsia, Klebsiella, Bordetella, Neisseria, Aeromonas, Francisella, Corynebacterium, Citrobacter, Chlamydia, Haemophilus, Brucella, Mycobacterium, Mycoplasma, Legionella, Rhodococcus, Pseudomonas, Helicobacter, Vibrio, Bacillus*, and *Erysipelothrix*. For example, *Rickettsia rickettsiae, Rickettsia prowazekii, Rickettsia tsutsugamushi, Rickettsia mooseri, Rickettsia sibirica, Bordetella bronchiseptica, Neisseria meningitidis, Neisseria gonorrhoeae, Aeromonas eucrenophila, Aeromonas salmonicida, Francisella tularensis, Corynebacterium pseudotuberculosis, Citrobacter freundii, Chlamydia pneumoniae, Haemophilus somnus, Brucella abortus, Mycobacterium intracellulare, Legionella pneumophila, Rhodococcus equi, Pseudomonas aeruginosa, Helicobacter mustelae, Vibrio cholerae, Bacillus subtilis, Erysipelothrix rhusiopathiae, Yersinia enterocolitica, Rochalimaea quintana*, and *Agrobacterium tumerfacium*.

*Salmonella* is exemplified herein, and particularly, *Salmonella typhimurium* strains, such as the strain designated VNP20009 or YS1646 (deposited under the accession number ATCC 202165), and the wild-type strain deposited as ATCC accession number 14028, or a strain having all of the identifying characteristics of the strain deposited under ATCC 14028. Other strains include, for example, RE88, SL7207, χ8429, χ8431, and χ8468. Exemplary *Salmonella* strains provided herein are immunostimulatory bacterium strains AST-104, AST-105, AST-106, AST-108, AST-110, AST-112, AST-113, AST-115, AST-117, AST-118, AST-119, AST-120, AST-121, AST-122, and AST-123. These strains can be further modified to encode immunostimulatory proteins that are gain-of-function variants of proteins in signaling pathways that lead to expression of type I interferon or other immune modulatory proteins. The immunostimulatory bacteria also can encode immunostimulatory proteins that increase the immune response in the tumor microenvironment, such as cytokines. The immunostimulatory bacteria also can be modified to preferentially infect immune cells in the tumor microenvironment or to infect tumor-resident immune cells, and/or to induce less cell death in such immune cells, as described herein. Sequences thereof and descriptions are provided in the detailed description, examples and sequence listing. The immunostimulatory bacteria can be derived from attenuated strains of bacteria, or they become attenuated by virtue of the modifications described herein, such as deletion of asd, whereby replication is limited in vivo.

It is understood that instances in which bacterial genes are modified and referenced herein, they are referenced with respect to their designation (name) in *Salmonella* species, which is exemplary of bacteria from which immunostimulatory bacteria can be produced. The skilled person recognizes that other species have corresponding proteins, but that their designation or name can be different from the name in *Salmonella*. The generic disclosure herein, however, can be applied to other bacterial species. For example, as shown herein, deletion or inactivation of flagellin$^-$ (fliC$^-$/fljB$^-$) in *Salmonella* and/or pagP results in increased colonization of tumors. Similar genes for flagella or similar functions for infection can be modified in other bacterial species to achieve increased tumor colonization. Similarly, inactivation/deletion of bacterial products, such as the products of pagP and/or msbB, as described herein, can reduce complement activation and/or other inflammatory responses, thereby increasing targeting to tumors, tumor-resident immune cells and the tumor microenvironment. Corresponding genes in other species that are involved in activating the complement pathway or other inflammatory pathway, can be deleted, as exemplified herein for *Salmonella*.

The immunostimulatory bacteria provided herein encode inhibitors of various genes that contribute to reduced anti-tumor immune responses and/or express genes and/or gene products and/or products that stimulate the immune system, and thereby are immunostimulatory.

The immunostimulatory bacteria provided herein have properties that render them immunostimulatory. Adenosine auxotrophy also is immunostimulatory. They also can encode, on the plasmid, therapeutic payloads, such as gain-of-function/constitutively active STING mutants, and other immunostimulatory proteins. The effects of this combination are enhanced by the strains provided herein that are auxotrophic for adenosine, which provides preferential accumulation in, or recruitment into, adenosine-rich immunosuppressive tumor microenvironments (TMEs). Reducing adenosine in such TMEs further enhances the immunostimulatory effects. Such combinations of traits in any of the bacterial strains known, or that can be engineered for therapeutic administration, provide similar immunostimulatory effects.

Engineered immunostimulatory bacteria, such as the *S. typhimurium* immunostimulatory bacteria provided herein, contain multiple synergistic modalities to induce immune re-activation of cold tumors to promote tumor antigen-specific immune responses, while inhibiting immune checkpoint pathways that the tumor utilizes to subvert and evade durable anti-tumor immunity. Included in embodiments is adenosine auxotrophy and enhanced vascular disruption. This improvement in tumor targeting through adenosine auxotrophy and enhanced vascular disruption increases potency, while localizing the inflammation to limit systemic cytokine exposure and the autoimmune toxicities observed with other immunotherapy modalities.

The heterologous proteins, such as the immunostimulatory proteins and gain-of-function immunostimulatory proteins, and RNAs are expressed on plasmids under the control of promoters that are recognized by the eukaryotic host cell transcription machinery, such as RNA polymerase II (RNAP II) and RNA polymerase III (RNAP III) promoters. RNAP III promoters generally are constitutively expressed in a eukaryotic host; RNAP II promoters can be regulated. The therapeutic products/immunostimulatory proteins are provided on plasmids stably expressed by the bacteria. Exemplary of such bacteria are *Salmonella* strains, generally attenuated strains, either attenuated by passage or other methods, or by virtue of modifications described herein, such as adenosine auxotrophy. Exemplary of *Salmonella* strains are modified *S. typhimurium* strains that have a defective asd gene. These bacteria can be modified to include carrying a functional asd gene on the introduced plasmid; this maintains selection for the plasmid so that an antibiotic-based plasmid maintenance/selection system is not needed. The asd defective strains that do not contain a functional asd gene on a plasmid are autolytic in the host.

The promoters can be selected for the environment of the tumor cell, such as a promoter expressed in a tumor microenvironment (TME), a promoter expressed in hypoxic conditions, or a promoter expressed in conditions where the pH is less than 7.

The plasmids in any of the bacteria described and enumerated above encode therapeutic products. Plasmids can be present in many copies or fewer. This can be controlled by selection of elements, such as the origin of replication. Low and high and medium copy number plasmids and origins of replication are well known to those of skill in the art and can be selected. In embodiments of the immunostimulatory bacteria here, the plasmid can be present in low to medium copy number, such as about 150 or 150 and fewer copies, to low copy number which is less than about 25 or about 20 or 25 copies. Exemplary origins of replication are those derived from pBR322, p15A, pSC101, pMB1, colE1, colE2, pPS10, R6K, R1, RK2, and pUC.

The plasmids encode therapeutic polypeptides, such as the polypeptides that induce type I interferons, such as those expressed in interferonopathies, and/or any therapeutic proteins described herein, and/or known to those of skill in the art for use in cancer therapies. The plasmids also can include sequences of nucleic acids encoding listeriolysin O (LLO) protein lacking the signal sequence (cytoLLO), a CpG motif, a DNA nuclear targeting sequence (DTS), and a retinoic acid-inducible gene-I (RIG-I) binding element. The immunostimulatory bacterium that comprises nucleic acids can include a CpG motif recognized by toll-like receptor 9 (TLR9). The CpG motif can be encoded on the plasmid. The CpG motif can be included in, or is part of, a bacterial gene that is encoded on the plasmid. For example, the gene that comprises CpGs can be asd, encoded on the plasmid. Immunostimulatory bacteria provided herein can include one or more of a CpG motif, an asd gene selectable marker for plasmid maintenance and a DNA nuclear targeting sequence.

The immunostimulatory bacteria can be flagellin deficient, such as by deletion of or disruption in a gene(s) encoding the flagella. For example, provided are immunostimulatory bacteria that contain deletions in the genes encoding one or both of flagellin subunits fliC and fljB, whereby the bacterium is flagella deficient, and wherein the wild-type bacterium expresses flagella. The immunostimulatory bacteria also can have a deletion or modification in the gene encoding endonuclease I (endA), whereby endA activity is inhibited or eliminated.

The immunostimulatory bacteria provided herein can be aspartate-semialdehyde dehydrogenase$^-$ (asd$^-$), which permits growth in DAP supplemented medium, but limits replication in vivo when administered to subjects for treatment. Such bacteria will be self-limiting, which can be advantageous for treatment. The bacterium can be asd$^-$ by virtue of disruption or deletion of all or a portion of the endogenous gene encoding aspartate-semialdehyde dehydrogenase (asd), whereby the endogenous asd is not expressed. In other embodiments, the gene encoding aspartate-semialdehyde dehydrogenase can be included on the plasmid for expression in vivo.

Any of the immunostimulatory bacteria provided herein can include nucleic acid, generally on the plasmid, that includes a CpG motif or a CpG island, wherein the CpG motif is recognized by toll-like receptor 9 (TLR9). Nucleic acid encoding CpG motifs or islands are plentiful in prokaryotes, and, thus, the CpG motif can be included in, or can be a part of, a bacterial gene that is encoded on the plasmid. For example, the bacterial gene asd contains immunostimulatory CpGs.

The immunostimulatory bacteria provided herein can be auxotrophic for adenosine, or adenosine and adenine. Any of the bacteria herein can be rendered auxotrophic for adenosine, which advantageously can increase the anti-tumor activity, since adenosine accumulates in many tumors, and is immunosuppressive.

The immunostimulatory bacteria provided herein can be flagellin deficient, where the wild-type bacterium comprises flagella. They can be rendered flagellin deficient by disrupting or deleting all or a part of the gene or genes that encode flagella. For example, provided are immunostimulatory bacteria that have deletions in the genes encoding one or both of flagellin subunits FliC and FljB, whereby the bacteria is flagella deficient.

The immunostimulatory bacteria provided herein can include a nucleic acid encoding cytoLLO, which is a listeriolysin O (LLO) protein lacking the periplasmic secretion signal sequence so that it accumulates in the cytoplasm. This mutation is advantageously combined with asd$^{-}$ bacteria. LLO is a cholesterol-dependent pore forming hemolysin from *Listeria monocytogenes* that mediates phagosomal escape of bacteria. When the autolytic strain is introduced into tumor-bearing hosts, such as humans, the bacteria are taken up by phagocytic immune cells and enter the vacuole. In this environment, the lack of DAP prevents bacterial replication, and results in autolysis of the bacteria in the vacuole. Lysis then releases the plasmid and the accumulated LLO forms pores in the cholesterol-containing vacuole membrane and allows for delivery of the plasmid into the cytosol of the host cell. Here, the therapeutic products can be expressed using the host cell machinery, and released into the tumor microenvironment to effect anti-tumor therapy.

The immunostimulatory bacteria can include a DNA nuclear targeting sequence (DTS), such as an SV40 DTS, encoded on the plasmid.

The immunostimulatory bacteria can have a deletion or modification in the gene encoding endonuclease-1 (endA), whereby endA activity is inhibited or eliminated. Exemplary of these are immunostimulatory bacteria that contain one or more of a CpG motif, an asd gene selectable marker for plasmid maintenance and a DNA nuclear targeting sequence.

The immunostimulatory bacteria can contain nucleic acids on the plasmid encoding two or more different RNA molecules that inhibit, suppress or disrupt expression of an immune checkpoint or an RNA molecule that encodes an inhibitor of a metabolite that is immunosuppressive or is in an immunosuppressive pathway.

The nucleic acids encoding the RNAi, such as shRNA or miRNA or siRNA can include a transcriptional terminator following the RNA-encoding nucleic acid. In all embodiments, the RNAi encoded on the plasmid in the immunostimulatory bacteria can be short hairpin RNAs (shRNAs) or micro-RNAs (miRNAs).

The plasmids in any of the immunostimulatory bacteria also can encode a sequence of nucleotides that is an agonist of retinoic acid-inducible gene I (RIG-I) or a RIG-I binding element.

The immunostimulatory bacteria can include one or more of deletions in genes, such as one or more of purI$^{-}$ (purM$^{-}$), msbB$^{-}$, purD$^{-}$, flagellin$^{-}$ (fliC$^{-}$/fljB$^{-}$), pagP$^{-}$, adrA$^{-}$, csgD$^{-}$ and hilA$^{-}$. The immunostimulatory bacteria can be msbB$^{-}$. For example, the immunostimulatory bacteria can contain one or more of a purI deletion, an msbB deletion, an asd deletion, and adrA deletion, and optionally a csgD deletion. Exemplary of bacterial gene deletions/modifications are any of the following:

one or more of a mutation in a gene that alters the biosynthesis of lipopolysaccharide selected from among one or more of rfaL, rfaG, rfaH, rfaD, rfaP, rFb, rfa, msbB, htrB, firA, pagL, pagP, lpxR, arnT, eptA, and lpxT; and/or one or more of a mutation that introduces a suicide gene and is selected from one or more of sacB, nuk, hok, gef, kil or phlA; and/or one or more of a mutation that introduces a bacterial lysis gene and is selected from one or both of hly and cly; and/or a mutation in one or more virulence factor(s) selected from among IsyA, pag, prg, iscA, virG, plc and act; and/or one or more mutations that modify the stress response selected from among recA, htrA, htpR, hsp and groEL; and/or a mutation in min that disrupts the cell cycle; and/or one or more mutations that disrupt or inactivate regulatory functions selected from among cya, crp, phoP/phoQ, and ompR.

The immunostimulatory bacterium can be a strain of *Salmonella, Shigella, E. coli*, Bifidobacteriae, *Rickettsia, Vibrio, Listeria, Klebsiella, Bordetella, Neisseria, Aeromonas, Francisella, Cholera, Corynebacterium, Citrobacter, Chlamydia, Haemophilus, Brucella, Mycobacterium, Mycoplasma, Legionella, Rhodococcus, Pseudomonas, Helicobacter, Bacillus*, or *Erysipelothrix*, or an attenuated strain thereof or modified strain thereof of any of the preceding list of bacterial strains.

Exemplary of the immunostimulatory bacteria are those where the plasmid contains one or more of a sequence of nucleic acids encoding a listeriolysin O (LLO) protein lacking the signal sequence (cytoLLO), a CpG motif, a DNA nuclear targeting sequence (DTS), and a retinoic acid-inducible gene-I (RIG-I) binding element.

Where the plasmid contains two or more therapeutic products under control of separate promoters each is separated by at least about 75 nucleotides, or at least 75 nucleotides, up to about or at least 100, 150, 200, 250, 300, 350, 400, 450, 500, 550, 600, 700, 800, 900, 1000, 1100, 1200, 1300, 1400, 1500 nucleotides (or base pairs), up to about 1600 or 1600 nucleotides (or base pairs), or between 75-1500 or 1600 nucleotides (or base pairs).

Other exemplary immunostimulatory bacteria include those that are auxotrophic for adenosine, and comprise: one or more of a deletion in the gene(s) encoding the flagella; a deletion in endA; a plasmid that encodes CytoLLO; a nuclear localization sequence; and an asd plasmid complementation system; and encode a therapeutic product, including a gain-of-function variants of an immunostimulatory protein that, in unmodified form, is part of a cytosolic DNA/RNA sensor pathway that leads to expression of type I interferon (IFN), such as any described herein.

Such immunostimulatory bacteria include strains of *Salmonella*, such as a wildtype *Salmonella typhimurium* strain, such as the strain deposited under ATCC® accession no. 14028, or a strain having all of the identifying characteristics of the strain deposited under ATCC accession number 14028. Other strains include, for example, an attenuated *Salmonella typhimurium* strain selected from among strains designated as AST-100, VNP20009, or strains YS1646 (deposited under ATCC accession number 202165), RE88, SL7207, $\chi$8429, $\chi$8431, and $\chi$8468.

The immunostimulatory bacteria can contain one or more of a purI deletion, an msbB deletion, an asd deletion, and an adrA deletion, in addition to the modifications that increase accumulation in tumor cells and/or reduce cell death, and can encode an immunostimulatory protein as described herein. The immunostimulatory bacteria also can include:

one or more of a mutation in a gene that alters the biosynthesis of lipopolysaccharide selected from among one or more of rfaL, rfaG, rfaH, rfaD, rfaP, rFb, rfa, msbB, htrB, firA, pagL, pagP, lpxR, arnT, eptA, and lpxT; and/or one or more of a mutation that introduces a suicide gene and is selected from among one or more of sacB, nuk, hok, gef, kil and phlA; and/or one or more of a mutation that introduces a bacterial lysis gene and is selected from among one or both of hly and cly; and/or a mutation in one or more virulence factor(s) selected from among IsyA, pag, prg, iscA, virG, plc and act; and/or one or more mutations that modify the stress response selected from among recA, htrA, htpR, hsp and groEL; and/or a mutation in min that disrupts the cell cycle; and/or one or more mutations that disrupt or inactivate regulatory functions selected from among cya, crp, phoP/phoQ and ompR.

The strains can be one or more of msbB, asd, hilA and/or flagellin$^-$ (fliC$^-$/fljB$^-$), and/or pagP$^-$. The therapeutic product, such as gain-of-function variants of an immunostimulatory protein that, in unmodified form, is part of a cytosolic DNA/RNA sensor pathway that leads to expression of type I interferon (IFN), RNAi, and immunostimulatory proteins, such as chemokines/cytokines, are expressed under control of a promoter recognized by the host, such as an RNAP III promoter or an RNAP II promoter, as described herein. The immunostimulatory bacterium can be a strain of *Salmonella, Shigella, E. coli*, Bifidobacteriae, *Rickettsia, Vibrio, Listeria, Klebsiella, Bordetella, Neisseria, Aeromonas, Francisella, Cholera, Corynebacterium, Citrobacter, Chlamydia, Haemophilus, Brucella, Mycobacterium, Mycoplasma, Legionella, Rhodococcus, Pseudomonas, Helicobacter, Bacillus*, or *Erysipelothrix*, or an attenuated strain thereof or a modified strain thereof of any of the preceding list of bacterial strains. Generally, the strain is one that is attenuated in the host, either as an attenuated strain or by virtue of the modifications that alter its properties, including cells it can infect and its ability to replicate in certain cells or all cells. *Salmonella* strains, such as *S. typhimurium*, are exemplary of the bacteria. Exemplary strains include *Salmonella typhimurium* strains derived from strains designated as AST-100, VNP20009, or strains YS1646 (ATCC accession no. 202165), RE88, SL7207, χ8429, χ8431, χ8468, and the wild-type strain deposited under ATCC accession number 14028.

Compositions containing the immunostimulatory bacteria are provided. Such compositions contain the bacteria and a pharmaceutically acceptable excipient or vehicle. The immunostimulatory bacteria include any described herein or in patents/applications incorporated herein or known to those of skill in the art. Such bacteria are modified to encode a variant of an immunostimulatory protein that is part of a signaling pathway resulting in expression of a type I interferon. The protein, such as a STING protein, is modified so that it has increased activity and/or leads to constitutive expression of the type I interferon, such as interferon-α or interferon-β. The bacteria can also encode an immunostimulatory protein that increases anti-tumor activity in the tumor microenvironment or in the tumor, such as a cytokine. The genomes of the bacteria can be modified to have increased infectivity of immune cells, and or reduced infectivity of non-immune cells, and/or reduced ability to induce cell death of immune cells. Hence, the bacteria are modified as described herein to accumulate in tumors or the tumor microenvironment or tumor-resident immune cells, and/or to deliver immunostimulatory proteins that promote anti-tumor activity. The immunostimulatory bacteria can additionally contain a plasmid encoding RNAi, such as miRNA or shRNA, or a CRISPR cassette, that target an immune checkpoint, or otherwise enhance the anti-tumor activity of the bacteria.

A single dose is therapeutically effective for treating a disease or disorder in which immune stimulation effects treatment. Exemplary of such stimulation is an immune response, that includes, but is not limited to, one or both of a specific immune response and non-specific immune response, specific and non-specific immune responses, an innate response, a primary immune response, adaptive immunity, a secondary immune response, a memory immune response, immune cell activation, immune cell proliferation, immune cell differentiation, and cytokine expression.

Provided are immunostimulatory bacteria that are cGAS agonists. Exemplary of such bacteria are *Salmonella* species, such as *S. typhimurium*, that is one or both of a cGAS agonist and Stimulator of Interferon Genes (STING) agonist. These can be administered, for example, in uses and methods, such as radiotherapy and chemotherapy, in which cytosolic DNA is produced or accumulates. STING activates innate immunity in response to sensing nucleic acids in the cytosol. Downstream signaling is activated through binding of cyclic dinucleotides (CDNs), which are synthesized by bacteria or by host enzyme cGAS in response to binding to cytosolic double stranded DNA (dsDNA). Bacterial and host-produced CDNs have distinct phosphate bridge structures, which differentiates their capacity to activate STING. CDNs are synthesized by bacteria or by host enzyme cGAS in response to binding cytosolic dsDNA. IFN-β is the signature cytokine of activated STING.

Also provided are modified non-human STING proteins and STING protein chimeras, as well as delivery vehicles, including any described herein, including the bacteria, liposomes, exosomes, minicells, nanoparticles, vectors, such as oncolytic virus, pharmaceutical compositions containing the proteins and/or the delivery vehicles, cells encoding or containing these STING proteins and/or containing the delivery vehicles, and uses thereof and methods of treatment of cancers. The modified non-human STING proteins and STING protein chimeras, as well as the delivery vehicles, cells, immunostimulatory bacteria, uses, methods and pharmaceutical compositions, include, but are not limited to:

1. Modified non-human STING proteins, where the non-human STING protein is one that has lower NF-κB activation than the human STING protein, and, optionally, higher type I interferon activation/signaling activity, compared to the wild type (WT) human STING protein. These non-human STING proteins are modified to include a mutation or mutations so that they have increased activity or act constitutively, in the absence of cytosolic nucleic acid signaling. The mutations are typically amino acid mutations that occur in interferonopathies in humans, such as those described above for human STING. The corresponding mutations are introduced into the non-human species STING proteins, where corresponding amino acid residues are identified by alignment (see, e.g., FIGS. 1-13). Also, in some embodiments, the TRAF6 binding site in the C-terminal tail (CTT) of the STING protein is deleted, reducing NF-κB signaling activity.
2. Modified STING proteins, particularly human STING proteins, that are chimeras, in which the CTT (C-terminal tail) region in the STING protein from one species, such as human, is replaced with the CTT from the STING protein of another, non-human species that has lower NF-κB signaling activity and/or higher type I IFN signaling activity than human STING. Also, the TRAF6 binding site is optionally deleted from the CTT in these chimeras.

3. The modified STING proteins of 2 that also include the mutations of 1.
4. Delivery vehicles, such as immunostimulatory bacteria, any provided herein or known to those of skill in the art, including exosomes, minicells, liposomes, nanoparticles, oncolytic viruses, and other viral vectors, that encode the modified STING proteins of any of 1-3.
5. Delivery vehicles, such as immunostimulatory bacteria, any provided herein or known to those of skill in the art, including exosomes, minicells, liposomes, nanoparticles, oncolytic viruses, and other viral vectors, that encode unmodified STING from non-human species whose STING protein has reduced NF-κB signaling activity compared to that of human STING, and optionally increased type I interferon stimulating/signaling activity.
6. Cells (non-zygotes, if human), such as cells used for cell therapy, such as T-cells and stem cells, and cells used to produce the proteins of any of 1-3.
7. Pharmaceutical compositions that contain the STING proteins of 1-3 or the delivery vehicles of 4 and 5, or the cells of 6.
8. Uses and methods of treatment of cancer by administering any of 1-7, as described herein for the immunostimulatory bacteria.
9. Also provided are immunostimulatory bacteria that encode non-human STING proteins, particularly any that have lower NF-κB activity (signaling activity) and similar or greater type I interferon stimulating activity or interferon-β stimulating activity compared to human STING.

Assays and methods to assess NF-κB activity (signaling activity) and type I interferon stimulating activity or interferon-β stimulating activity of STING are described herein, and also are known to those of skill in the art. Methods include those described, for example, in de Oliveira Mann et al. (2019) *Cell Reports* 27:1165-1175, which describes, inter alia, the interferon-β and NF-κB signaling activity of STING proteins from various species, including human, thereby identifying STING proteins from various species that have lower NF-κB activity than human STING, and those that also have comparable or higher interferon-β activity than human STING. de Oliveira Mann et al. (2019) provides species alignments and identifies domains of STING in each species, including the CTT domain (see, also, the Supplemental Information for de Oliveira Mann et al. (2019)).

The non-human STING proteins can be, but are not limited to, STING proteins from the following species: Tasmanian devil (*Sarcophilus harrisii*; SEQ ID NO:331), marmoset (*Callithrix jacchus*; SEQ ID NO:341), cattle (*Bos taurus*; SEQ ID NO:342), cat (*Felis catus*; SEQ ID NO:338), ostrich (*Struthio camelus australis*; SEQ ID NO:343), crested ibis (*Nipponia nippon*; SEQ ID NO:344), coelacanth (*Latimeria chalumnae*; SEQ ID NOs:345-346), boar (*Sus scrofa*; SEQ ID NO:347), bat (*Rousettus aegyptiacus*; SEQ ID NO:348), manatee (*Trichechus manatus latirostris*; SEQ ID NO:349), ghost shark (*Callorhinchus milii*; SEQ ID NO:350), mouse (*Mus musculus*, SEQ ID NO:351), and zebrafish (*Danio rerio*; SEQ ID NO:330). These vertebrate STING proteins readily activate immune signaling in human cells, indicating that the molecular mechanism of STING signaling is shared in vertebrates (see, de Oliveira Mann et al. (2019) *Cell Reports* 27:1165-1175).

Pharmaceutical compositions containing any of the immunostimulatory bacteria and other delivery vehicles also are provided. As are uses thereof for treatment of cancers, and methods of treatment of cancer. Methods and uses include treating a subject who has cancer, comprising administering an immunostimulatory bacterium or the pharmaceutical composition to a subject, such as a human. A method of treating a subject who has cancer, comprising administering an immunostimulatory bacterium, is provided.

Methods and uses include combination therapy in which a second anti-cancer agent or treatment is administered. The second anti-cancer agent can be a chemotherapeutic agent that results in cytosolic DNA, or radiotherapy, or an immune checkpoint inhibitor, such as an anti-PD-1, or anti-PD-L1 or anti-CTLA-4 antibody, or CAR-T cells or other therapeutic cells, such as stem cells, TIL cells and modified cells for cancer therapy.

Administration can be by any suitable route, such as parenteral, and can include additional agents that can facilitate or enhance delivery. Administration can be oral or rectal or by aerosol into the lung, or intratumoral, intravenously, intramuscularly, or subcutaneously. Administration can be by any suitable route, including systemic or local or topical, such as parenteral, including, for example, oral or rectal or by aerosol into the lung, intratumoral, intravenously, intramuscularly, or subcutaneously.

Cancers include solid tumors and hematologic malignancies, such as, but not limited to, lymphoma, leukemia, gastric cancer, and cancer of the breast, heart, lung, small intestine, colon, spleen, kidney, bladder, head and neck, colorectum, ovary, prostate, brain, pancreas, skin, bone, bone marrow, blood, thymus, uterus, testicles, cervix, and liver.

The immunostimulatory bacteria can be formulated into compositions for administration, such as suspensions. They can be dried and stored as powders. Combinations of the immunostimulatory bacteria with other anti-cancer agents also are provided.

Combination therapies for treatment of cancers and malignancies are provided. The immunostimulatory bacteria can be administered before, after, intermittently with, or concurrently with, other cancer therapies, including radiotherapy, chemotherapies, particularly genotoxic chemotherapies that result in cytosolic DNA, and immunotherapies, such as checkpoint inhibitor antibodies, including anti-PD-1 antibodies, anti-PD-L1 antibodies, and anti-CTLA-4 antibodies, and other such immunotherapies.

Also provided are isolated cells that contain the immunostimulatory bacteria or that contain any of the other delivery vehicles, such as exosomes, liposomes and other such vehicles, that contain nucleic acids encoding the gain-of-function variant proteins and other therapeutic products as described herein. Cells include, but are not limited to, immune cells, stem cells, tumor cells, primary cell lines, and other cells used in cell therapy. Exemplary cells include, for example, hematopoietic cells, such as T-cells, and hematopoietic stem cells. The hematopoietic cell can be a chimeric antigen myeloid cell, such as a macrophage. The delivery vehicles and immunostimulatory bacteria can be introduced into the cells ex vivo. Thus, for example, provided are isolated cells that contain immunostimulatory bacteria, where: the immunostimulatory bacterium is modified so that it preferentially infects tumor-resident immune cells, and/or the genome of the immunostimulatory bacterium is modified so that it induces less cell death in tumor-resident immune cells; and the cell is an immune cell, a stem cell, a cell from a primary cell line, or a tumor cell. The cells are used in methods of cell therapy, such as for the treatment of cancers. The cells can be allogeneic or autologous to the subject treated.

Also provided are methods for increasing tumor/tumor microenvironment colonization by an immunostimulatory bacterium. The methods include, for example, modifying the genome of a bacterium to render the bacterium flagellin$^-$ (fliC$^-$/fljB$^-$) and/or pagP$^-$.

The terms and expressions that are employed are used as terms of description and not of limitation, and there is no intention in the use of such terms and expressions to exclude any equivalents of the features shown and described or portions thereof, but it is recognized that various modifications are contemplated.

BRIEF DESCRIPTION OF THE DRAWINGS

FIG. 1 depicts the alignment of wild-type human STING (SEQ ID NO:306) and Tasmanian devil STING (SEQ ID NO:331) proteins.

FIG. 2 depicts the alignment of wild-type human STING (SEQ ID NO:306) and marmoset STING (SEQ ID NO:341) proteins.

FIG. 3 depicts the alignment of wild-type human STING (SEQ ID NO:306) and cattle STING (SEQ ID NO:342) proteins.

FIG. 4 depicts the alignment of wild-type human STING (SEQ ID NO:306) and cat STING (SEQ ID NO:338) proteins.

FIG. 5 depicts the alignment of wild-type human STING (SEQ ID NO:306) and ostrich STING (SEQ ID NO:343) proteins.

FIG. 6 depicts the alignment of wild-type human STING (SEQ ID NO:306) and crested ibis STING (SEQ ID NO:344) proteins.

FIG. 7 depicts the alignment of wild-type human STING (SEQ ID NO:306) and coelacanth STING (SEQ ID NO:345) proteins.

FIG. 8 depicts the alignment of wild-type human STING (SEQ ID NO:306) and zebrafish STING (SEQ ID NO:330) proteins.

FIG. 9 depicts the alignment of wild-type human STING (SEQ ID NO:305) and boar STING (SEQ ID NO:347) proteins.

FIG. 10 depicts the alignment of wild-type human STING (SEQ ID NO:305) and bat STING (SEQ ID NO:348) proteins.

FIG. 11 depicts the alignment of wild-type human STING (SEQ ID NO:305) and manatee STING (SEQ ID NO:349) proteins.

FIG. 12 depicts the alignment of wild-type human STING (SEQ ID NO:305) and ghost shark STING (SEQ ID NO:350) proteins.

FIG. 13 depicts the alignment of wild-type human STING (SEQ ID NO:305) and mouse STING (SEQ ID NO:351) proteins.

DETAILED DESCRIPTION

Outline

A. DEFINITIONS
B. OVERVIEW OF THE IMMUNOSTIMULATORY BACTERIA
C. CANCER IMMUNOTHERAPEUTICS
  1. Immunotherapies
  2. Adoptive Immunotherapies
  3. Cancer Vaccines and Oncolytic Viruses
D. BACTERIAL CANCER IMMUNOTHERAPY
  1. Bacterial Therapies
  2. Comparison of the Immune Responses to Bacteria and Viruses
  3. *Salmonella* Therapy
    a. Tumor-tropic Bacteria
    b. *Salmonella enterica* serovar *typhimurium*
    c. Bacterial Attenuation
      i. msbB$^-$ Mutants
      ii. purr Mutants
      iii. Combinations of Attenuating Mutations
      iv. VNP20009 and Other Attenuated *S. typhimurium* strains
      v. *S. typhimurium* Engineered To Deliver Macromolecules
  4. Enhancements of Immunostimulatory Bacteria to Increase Therapeutic Index and Expression in Tumor-Resident Immune Cells
    a. asd Gene Deletion
    b. Adenosine Auxotrophy
    c. Flagellin Deficient Strains
    d. Deletion of Genes in the LPS Biosynthetic Pathway
    e. Deletions in Genes Required for Biofilm Formation
    f. *Salmonella* Engineered to Escape the *Salmonella* Containing Vacuole (SCV)
    g. Deletions of SPI-1 and SPI-2 Genes and/or Other Genes to Eliminate the Ability of the Bacteria to Infect Epithelial Cells, Including Deletion of Flagella
      i. *Salmonella* Pathogenicity Island 1 (SPI-1)
        SPI-1-Dependent Host Cell Invasion
        SPI-1-Independent Host Cell Invasion
      ii. *Salmonella* Pathogenicity Island 2 (SPI-2)
    h. Endonuclease-1 (endA) Mutations to Increase Plasmid Delivery
    i. RIG-I Binding Sequences
    j. DNase II Inhibition
    k. RNase H2 Inhibition
    l. Stabilin-1/CLEVER-1 Inhibition
    m. CpG Motifs and CpG Islands
  5. Modifications that Increase Uptake of Gram-Negative Bacteria, such as *Salmonella*, by Immune Cells, and Reduce Immune Cell Death
    a. Bacterial Uptake by Immune cells
    b. Macrophage Pyroptosis
      i. Flagellin
      ii. SPI-1 T3SS Effectors
        Rod Protein (PrgJ)
        Needle protein (PrgI)
      iii. QseC
  6. Bacterial Culture Conditions
  7. Increased Tumor Colonization
E. NON-HUMAN STING PROTEINS AND GAIN-OF-FUNCTION MUTATIONS IN PROTEINS THAT STIMULATE THE IMMUNE RESPONSE IN THE TUMOR MICROENVIRONMENT
  1. Type I Interferons and Pathways
  2. Type I Interferonopathies and Gain-of-Function Mutants
  3. STING-Mediated Immune Activation
  4. TMEM173 Alleles 5. Constitutive STING Expression and Gain-of-Function Mutations
6. Non-human STING Proteins, and Variants Thereof with Increased or Constitutive Activity, and STING Chimeras, and Variants Thereof with Increased or Constitutive Activity
7. Other Gene Products that Act as Cytosolic DNA/RNA Sensors and Constitutive Variants
a. Retinoic Acid-Inducible Gene I (RIG-I)-Like Receptors (RLRs)
b. MDA5/IFIH1
c. RIG-I
d. IRF-3 and IRF-7
8. Other Type I IFN Regulatory Proteins
9. Other Therapeutic Products
F. IMMUNOSTIMULATORY BACTERIA ENCODING THE PROTEINS AND CONSTRUCTION OF EXEMPLARY PLASMIDS AND DELIVERY VEHICLES
1. Origin of Replication and Plasmid Copy Number
2. Plasmid Maintenance/Selection Components
3. RNA Polymerase Promoters
4. DNA Nuclear Targeting Sequences
5. CRISPR
G. OTHER DELIVERY VEHICLES ENCODING THE NON-HUMAN STING PROTEINS AND GAIN-OF-FUNCTION MODIFIED PROTEINS THAT CONSTITUTIVELY INDUCE TYPE I INTERFERON AND OTHER THERAPEUTIC PRODUCTS
1. Exosomes, Extracellular Vesicles, And Other Vesicular Delivery Vehicles
2. Oncolytic Viruses
a. Adenovirus
b. Herpes Simplex Virus
c. Poxvirus
d. Measles Virus
e. Reovirus
f. Vesicular Stomatitis Virus (VSV)
g. Newcastle Disease Virus
h. Parvovirus
i. Coxsackie Virus
j. Seneca Valley Virus
H. PHARMACEUTICAL PRODUCTION, COMPOSITIONS, AND FORMULATIONS
1. Manufacturing
a. Cell Bank Manufacturing
b. Drug Substance Manufacturing
c. Drug Product Manufacturing
2. Compositions
3. Formulations
a. Liquids, Injectables, Emulsions
b. Dried Thermostable Formulations
4. Compositions for Other Routes of Administration
5. Dosages and Administration
6. Packaging and Articles of Manufacture
I. METHODS OF TREATMENT AND USES
1. Tumors
2. Administration
3. Monitoring
J. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, GenBank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information.

As used herein, therapeutic bacteria are bacteria that effect therapy, such as cancer or anti-tumor therapy, when administered to a subject, such as a human.

As used herein, immunostimulatory bacteria are therapeutic bacteria that, when introduced into a subject, accumulate in immunoprivileged tissues and cells, such as tumors, and replicate and/or express products that are immunostimulatory or that result in immunostimulation. For example, the immunostimulatory bacteria are attenuated in the host by virtue of reduced toxicity or pathogenicity and/or by virtue of encoded products that reduce toxicity or pathogenicity, as the immunostimulatory bacteria cannot replicate and/or express products (or have reduced replication/product expression), except primarily in immunoprivileged environments. Immunostimulatory bacteria provided herein are modified to encode a product or products or exhibit a trait or property that renders them immunostimulatory. Such products, properties and traits include, but are not limited to, for example, at least one of: an immunostimulatory protein, such as a cytokine or co-stimulatory molecule; a DNA/RNA sensor or gain-of-function variant thereof (e.g., STING, MDA5, RIG-I); RNAi, such as siRNA (shRNA and microRNA), CRISPR, that targets, disrupts or inhibits a checkpoint gene such as TREX1 and/or PD-L1; or an inhibitor of an immune checkpoint such as an anti-immune checkpoint antibody. Immunostimulatory bacteria also can include a modification that renders the bacterium auxotrophic for a metabolite that is immunosuppressive or that is in an immunosuppressive pathway, such as adenosine.

As used herein, the strain designations VNP20009 (see, e.g., International PCT Application Publication No. WO 99/13053, see, also U.S. Pat. No. 6,863,894) and YS1646 and 41.2.9 are used interchangeably and each refer to the strain deposited with the American Type Culture Collection and assigned Accession No. 202165. VNP20009 is a modified attenuated strain of *Salmonella typhimurium*, which contains deletions in msbB and purI, and was generated from wild type strain ATCC 14028.

As used herein, the strain designations YS1456 and 8.7 are used interchangeably and each refer to the strain deposited with the American Type Culture Collection and assigned Accession No. 202164 (see, U.S. Pat. No. 6,863,894).

As used herein, an interferonopathy refers to a disorder associated with an upregulation of interferon by virtue of a mutation in a gene product involved in a pathway that regulates or induces expression of interferon. The activity of the products normally is regulated by a mediator, such as cytosolic DNA or RNA or nucleotides; when mutated, the activity is constitutive. Type I interferonopathies include a spectrum of conditions, including the severe forms of Aicardi-Goutières Syndrome (AGS) and the milder Familial Chilblain Lupus (FCL). Nucleic acid molecules encoding mutated products with these properties can be produced in vitro, such as by selecting for mutations that result in a gain-of-function in the product, compared to the product of an allele that has normal activity, or has further gain-of-function compared to the disease-associated gain-of-function mutants described herein.

As used herein, a gain-of-function mutation is one that increases the activity of a protein compared to the same protein that does not have the mutation. For example, if the protein is a receptor, it will have increased affinity for a ligand; if it is an enzyme, it will have increased activity, including constitutive activity.

As used herein, an origin of replication is a sequence of DNA at which replication is initiated on a chromosome, plasmid or virus. For small DNA, including bacterial plasmids and small viruses, a single origin is sufficient.

The origin of replication determines the vector copy number, which depends upon the selected origin of replication. For example, if the expression vector is derived from the low-copy-number plasmid pBR322, it is between about 25-50 copies/cell, and if derived from the high-copy-number plasmid pUC, it can be 150-200 copies/cell.

As used herein, medium copy number of a plasmid in cells is about or is 150 or less than 150, low copy number is 15-30, such as 20 or less than 20. Low to medium copy number is less than 150. High copy number is greater than 150 copies/cell.

As used herein, 2A peptides are 18-22 amino-acid (aa)-long viral oligopeptides that mediate cleavage of polypeptides during translation in eukaryotic cells. The designation "2A" refers to a specific region of the viral genome and different viral 2As have generally been named after the virus they were derived from. Exemplary of these are F2A (foot-and-mouth disease virus 2A), E2A (equine rhinitis A virus), P2A (porcine teschovirus-1 2A), and T2A (Thosea asigna virus 2A). (See, e.g., Liu et al. (2017) *Scientific Reports* 7:2193, FIG. 1, for encoding sequences; see, also, SEQ ID NOs:367-370).

As used herein, a CpG motif is a pattern of bases that include an unmethylated central CpG ("p" refers to the phosphodiester link between consecutive C and G nucleotides) surrounded by at least one base flanking (on the 3' and the 5' side of) the central CpG. A CpG oligodeoxynucleotide is an oligodeoxynucleotide that is at least about ten nucleotides in length and includes an unmethylated CpG. At least the C of the 5' CG 3' is unmethylated.

As used herein, a RIG-I binding sequence refers to a 5'triphosphate (5'ppp) structure directly, or that which is synthesized by RNA pol III from a poly(dA-dT) sequence, which by virtue of interaction with RIG-I can activate type I IFN via the RIG-I pathway. The RNA includes at least four A ribonucleotides (A-A-A-A); it can contain 4, 5, 6, 7, 8, 9, 10 or more. The RIG-I binding sequence is introduced into a plasmid in the bacterium for transcription into the polyA.

As used herein, "cytokines" are a broad and loose category of small proteins (~5-20 kDa) that are important in cell signaling. Cytokines include chemokines, interferons, interleukins, lymphokines, and tumor necrosis factors. Cytokines are cell signaling molecules that aid cell to cell communication in immune responses, and stimulate the movement of cells towards sites of inflammation, infection and trauma.

As used herein, "chemokines" refer to chemoattractant (chemotactic) cytokines that bind to chemokine receptors and include proteins isolated from natural sources as well as those made synthetically, as by recombinant means or by chemical synthesis. Exemplary chemokines include, but are not limited to, IL-8, IL-10, GCP-2, GRO-α, GRO-β, GRO-γ, ENA-78, PBP, CTAP III, NAP-2, LAPF-4, MIG (CXCL9), CXCL10, CXCL11, PF4, IP-10, SDF-1α, SDF-1β, SDF-2, MCP-1, MCP-2, MCP-3, MCP-4, MCP-5, MIP-1α (CCL3), MIP-1β (CCL4), MIP-1γ, MIP-2, MIP-2α, MIP-3α, MIP-3β MIP-4, MIP-5, MDC, HCC-1, ALP, lungkine, Tim-1, eotaxin-1, eotaxin-2, I-309, SCYA17, TRAC, RANTES (CCL5), DC-CK-1, lymphotactin, and fractalkine, and others known to those of skill in the art. Chemokines are involved in the migration of immune cells to sites of inflammation, as well as in the maturation of immune cells and in the generation of adaptive immune responses.

As used herein, an "immunostimulatory protein" is a protein that exhibits or promotes an anti-tumor immune response in the tumor microenvironment. Exemplary of such proteins are cytokines, chemokines, and co-stimulatory molecules, such as, but not limited to, GM-CSF, IL-2, IL-7, IL-12, IL-15, IL-18, IL-21, IL-23, IL-36 gamma, IFNα, IFNβ, IL-12p70 (IL-12p40+IL-12p35), IL-15/IL-15R alpha chain complex, CXCL9, CXCL10, CXCL11, CCL3, CCL4, CCL5, molecules involved in the potential recruitment/persistence of T cells, CD40, CD40 ligand (CD40L), OX40, OX40 ligand (OX40L), 4-1BB, 4-1BB ligand (4-1BBL), members of the B7-CD28 family and members of the TNFR superfamily.

As used herein, a cytosolic DNA/RNA sensor pathway is one that is initiated by the presence of DNA, RNA, nucleotides, dinucleotides, cyclic nucleotides and/or cyclic dinucleotides or other nucleic acid molecules, that leads to production of type I interferon. The nucleic acid molecules in the cytosol occur from viral or bacterial or radiation or other such exposure, leading to activation of an immune response in a host.

As used herein, an immunostimulatory protein that induces an innate immune response, such as induction of type I interferon, is a protein that is part of a cytosolic DNA/RNA sensor pathway that leads to expression of the immune response mediator, such as type I interferon. For example, as described herein and known to those of skill in the art, cytosolic DNA is sensed by cGAS, leading to the production of cGAMP and subsequent STING (Stimulator of Interferon Genes)/TBK1 (TANK-binding kinase 1)/IRF3 (interferon regulatory factor) signaling, and type I IFN production. Bacterial cyclic dinucleotides (CDNs, such as bacterial cyclic di-AMP) also activate STING. Hence, STING is an immunostimulatory protein that induces type I interferon. 5'-triphosphate RNA and double stranded RNA are sensed by RIG-I and either MDA-5 alone or MDA-5/LGP2. This leads to polymerization of mitochondrial MAVS (mitochondrial antiviral-signaling protein), and also activates TBK1 and IRF3. The proteins in such pathways are immunostimulatory proteins that lead to expression of innate immune response mediators, such as type I interferon. The immunostimulatory proteins in the DNA/RNA sensor pathways can be modified so that they have increased activity or act constitutively, in the absence of cytosolic nucleic acid, to lead to the immune response, such as expression of type I interferon.

As used herein, the "carboxy-terminal tail" or "C-terminal tail" (CTT) of the innate immune protein STING refers to the C-terminal portion of a STING protein that, in a wild-type STING protein, is tethered to the cGAMP-binding domain by a flexible linker region. The CTT includes an IRF3 binding site, a TBK1 binding site, and a TRAF6 binding site. STING promotes the induction of interferon beta (IFN-β) production via the phosphorylation of the STING protein C-terminal tail (CTT) by TANK-binding kinase 1 (TBK1). The interaction between STING and TBK1 is mediated by an evolutionarily conserved stretch of eight amino-acid residues in the carboxy-terminal tail (CTT) of STING. TRAF6 catalyzes the formation of K63-linked ubiquitin chains on STING, leading to the activation of the transcription factor NF-κB and the induction of an alternative STING-dependent gene expression program. Deletion of the TRAF6 binding site in the CTT can reduce activation of NF-κB signaling. Substitution of the human CTT (or portions thereof) with the CTT (or corresponding portion thereof) from STING of species with low NF-κB activation can decrease NF-κB activation by human STING. The STING CTT is an unstructured stretch of ~40 amino acids that contains sequence motifs required for STING phosphorylation and recruitment of IRF3 (see, de Oliveira Mann et al. (2019) *Cell Reports* 27:1165-1175). Human STING residue S366 has been identified as a primary TBK1 phosphorylation site that is part of an LxIS motif shared among innate immune adaptor proteins that activate interferon signaling (see, de Oliveira Mann et al. (2019) *Cell Reports* 27:1165-1175). The human STING CTT contains a second PxPLR motif that includes the residue L374, which is required for TBK1 binding; the LxIS and PxPLR sequences are conserved among vertebrate STING alleles (see, de Oliveira Mann et al. (2019) *Cell Reports* 27:1165-1175). Exemplary STING CTT sequences, and the IRF3, TBK1 and TRAF6 binding sites are set forth in the following table:

| Species | C-terminal Tail (CTT) Sequence | SEQ ID NO. | IRF3 Binding Site | TBK1 Binding Site | TRAF6 Binding Site |
|---|---|---|---|---|---|
| Human | EKEEVTVGSLKTSAVPSTSTMS QEPELLISGMEKPLPLRTDFS | 352 | PELLIS | PLPLRT | DFS |
| Tasmanian devil | RQEEFAIGPKRAMTVTTSSTLS QEPQLLISGMEQPLSLRTDGF | 353 | PQLLIS | PLSLRT | DGF |
| Marmoset | EEEEVTVGSLKTSEVPSTSTMS QEPELLISGMEKPLPLRSDLF | 354 | PELLIS | PLPLRS | DLF |
| Cattle | EREVTMGSTETSVMPGSSVLS QEPELLISGLEKPLPLRSDVF | 355 | PELLIS | PLPLRS | DVF |
| Cat | EREVTVGSVGTSMVRNPSVLS QEPNLLISGMEQPLPLRTDVF | 356 | PNLLIS | PLPLRT | DVF |
| Ostrich | RQEEYTVCDGTLCSTDLSLQIS ESDLPQPLRSDCL | 357 | LSLQIS | PQPLRS | DCL |
| Boar | EREVTMGSAETSVVPTSSTLSQ EPELLISGMEQPLPLRSDIF | 358 | PELLIS | PLPLRS | DIF |
| Bat | EKEEVTVGTVGTYEAPGSSTL HQEPELLISGMDQPLPLRTDIF | 359 | PELLIS | PLPLRT | DIF |
| Manatee | EREEVTVGSVGTSVVPSPSSPS TSSLSQEPKLLISGMEQPLPLRT DVF | 360 | PKLLIS | PLPLRT | DVF |
| Crested ibis | CHEEYTVYEGNQPHNPSTTLH STELNLQISESDLPQPLRSDCF | 361 | LNLQIS | PQPLRS | DCF |
| Coelacanth (variant 1) | QKEEYFMSEQTQPNSSSTSCLS TEPQLMISDTDAPHTLKRQVC | 362 | PQLMIS | PHTLK R | QVC |
| Coelacanth (variant 2) | QKEEYFMSEQTQPNSSSTSCLS TEPQLMISDTDAPHTLKSGF | 363 | PQLMIS | PHTLKS | GF |
| Zebrafish | DGEIFMDPTNEVHPVPEEGPV GNCNGALQATFHEEPMSDEPT LMFSRPQSLRSEPVETTDYFNP SSANIKQN | 364 | PTLMFS | PQSLRS | EPVETTDY |
| Ghost shark | LTEYPVAEPSNANETDCMSSE PHLMISDDPKPLRSYCP | 365 | PHLMIS | PKPLRS | YCP |
| Mouse | EKEEVTMNAPMTSVAPPPSVL SQEPRLLISGMDQPLPLRTDLI | 366 | PRLLIS | PLPLRT | DLI |

As used herein, a bacterium that is modified so that it "induces less cell death in tumor-resident immune cells" is one that is less toxic than the bacterium without the modification, or one that has reduced virulence compared to the bacterium without the modification. Exemplary of such modifications are those that eliminate pyroptosis and that alter LPS profiles on the bacterium. These modifications include disruption of or deletion of flagellin genes, one or more components of the SPI-1 pathway, such as hilA, rod protein, needle protein, QseC and pagP.

As used herein, a bacterium that is "modified so that it preferentially infects tumor-resident immune cells" has a modification in its genome that reduces its ability to infect cells other than immune cells. Exemplary of such modifications are modifications that disrupt the type 3 secretion system or type 4 secretion system or other genes or systems that affect the ability of a bacterium to invade a non-immune cell. For example, disruption/deletion of an SPI-1 component, which is needed for infection of cells, such as epithelial cells, but does not affect infection of immune cells, such as phagocytic cells, by *Salmonella.*

As used herein, a "modification" is in reference to modification of a sequence of amino acids of a polypeptide or a sequence of nucleotides in a nucleic acid molecule and includes deletions, insertions, and replacements of amino acids or nucleotides, respectively. Methods of modifying a polypeptide are routine to those of skill in the art, such as by using recombinant DNA methodologies.

As used herein, a modification to a bacterial genome or to a plasmid or gene includes deletions, replacements and insertions of nucleic acid.

As used herein, RNA interference (RNAi) is a biological process in which RNA molecules inhibit gene expression or translation, by neutralizing targeted mRNA molecules to inhibit translation and thereby expression of a targeted gene.

As used herein, RNA molecules that act via RNAi are referred to as inhibitory by virtue of their silencing of expression of a targeted gene. Silencing expression means that expression of the targeted gene is reduced or suppressed or inhibited.

As used herein, gene silencing via RNAi is said to inhibit, suppress, disrupt or silence expression of a targeted gene. A targeted gene contains sequences of nucleotides that correspond to the sequences in the inhibitory RNA, whereby the inhibitory RNA silences expression of mRNA. Small interfering RNAs (siRNAs) are small pieces of double-stranded (ds) RNA, usually about 21 nucleotides long, with 3' overhangs (2 nucleotides) at each end that can be used to "interfere" with the translation of proteins by binding to and promoting the degradation of messenger RNA (mRNA) at specific sequences. In doing so, siRNAs prevent the production of specific proteins based on the nucleotide sequences of their corresponding mRNAs. The process is called RNA interference (RNAi), and also is referred to as siRNA silencing or siRNA knockdown. A short-hairpin RNA or small-hairpin RNA (shRNA) is an artificial RNA molecule with a tight hairpin turn that can be used to silence target gene expression via RNA interference (RNAi). Expression of shRNA in cells is typically accomplished by delivery of plasmids or through viral or bacterial vectors.

As used herein, inhibiting, suppressing, disrupting or silencing a targeted gene refers to processes that alter expression, such as translation, of the targeted gene, whereby activity or expression of the product encoded by the targeted gene is reduced. Reduction includes a complete knock-out or a partial knockout, whereby, with reference to the immunostimulatory bacteria provided herein and administration herein, treatment is effected.

As used herein, a tumor microenvironment (TME) is the cellular environment in which the tumor exists, including surrounding blood vessels, immune cells, fibroblasts, bone marrow-derived inflammatory cells, lymphocytes, signaling molecules and the extracellular matrix (ECM). Conditions that exist include, but are not limited to, increased vascularization, hypoxia, low pH, increased lactate concentration, increased pyruvate concentration, increased interstitial fluid pressure and altered metabolites or metabolism, such as higher levels of adenosine, indicative of a tumor.

As used herein, human type I interferons (IFNs) are a subgroup of interferon proteins that regulate the activity of the immune system. All type I IFNs bind to a specific cell surface receptor complex, such as the IFN-α receptor. Type I interferons include IFN-α and IFN-β, among others. IFN-β proteins are produced by fibroblasts, and have antiviral activity that is involved mainly in innate immune response. Two types of IFN-β are IFN-β1 (IFNB1) and IFN-β3 (IFNB3).

As used herein, recitation that a nucleic acid or encoded RNA targets a gene means that it inhibits or suppresses or silences expression of the gene by any mechanism. Generally, such nucleic acid includes at least a portion complementary to the targeted gene, where the portion is sufficient to form a hybrid with the complementary portion.

As used herein, "deletion," when referring to a nucleic acid or polypeptide sequence, refers to the deletion of one or more nucleotides or amino acids compared to a sequence, such as a target polynucleotide or polypeptide or a native or wild-type sequence.

As used herein, "insertion," when referring to a nucleic acid or amino acid sequence, describes the inclusion of one or more additional nucleotides or amino acids, within a target, native, wild-type or other related sequence. Thus, a nucleic acid molecule that contains one or more insertions compared to a wild-type sequence, contains one or more additional nucleotides within the linear length of the sequence.

As used herein, "additions" to nucleic acid and amino acid sequences describe addition of nucleotides or amino acids onto either termini compared to another sequence.

As used herein, "substitution" or "replacement" refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Amino acid replacements compared to a particular polypeptide can be expressed in terms of the number of the amino acid residue along the length of the polypeptide sequence.

As used herein, "at a position corresponding to," or recitation that nucleotides or amino acid positions "correspond to" nucleotides or amino acid positions in a disclosed sequence, such as set forth in the Sequence Listing, refers to nucleotides or amino acid positions identified upon alignment with the disclosed sequence to maximize identity using a standard alignment algorithm, such as the GAP algorithm. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g., *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; *Sequence Analysis Primer*, Gribskov, M. and Devereux, J., eds., M Stockton Press, New York, 1991; and Carrillo et al. (1988) *SIAM J Applied Math* 48:1073).

As used herein, alignment of a sequence refers to the use of homology to align two or more sequences of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence. Related or variant polypeptides or nucleic acid molecules can be aligned by any method known to those of skill in the art. Such methods typically maximize matches, and include methods, such as using manual alignments and by using the numerous alignment programs available (e.g., BLASTP) and others known to those of skill in the art. By aligning the sequences of polypeptides or nucleic acids, one skilled in the art can identify analogous portions or positions, using conserved and identical amino acid residues as guides. Further, one skilled in the art also can employ conserved amino acid or nucleotide residues as guides to find corresponding amino acid or nucleotide residues between and among human and non-human sequences. Corresponding positions also can be based on structural alignments, for example by using computer simulated alignments of protein structure. In other instances, corresponding regions can be identified. One skilled in the art also can employ conserved amino acid residues as guides to find corresponding amino acid residues between and among human and non-human sequences.

As used herein, a "property" of a polypeptide, such as an antibody, refers to any property exhibited by a polypeptide, including, but not limited to, binding specificity, structural configuration or conformation, protein stability, resistance to proteolysis, conformational stability, thermal tolerance, and tolerance to pH conditions. Changes in properties can alter an "activity" of the polypeptide. For example, a change in the binding specificity of the antibody polypeptide can alter the ability to bind an antigen, and/or various binding activities, such as affinity or avidity, or in vivo activities of the polypeptide.

As used herein, an "activity" or a "functional activity" of a polypeptide, such as an antibody, refers to any activity exhibited by the polypeptide. Such activities can be empirically determined. Exemplary activities include, but are not limited to, ability to interact with a biomolecule, for example, through antigen-binding, DNA binding, ligand binding, or dimerization, or enzymatic activity, for example, kinase activity or proteolytic activity. For an antibody (including antibody fragments), activities include, but are not limited to, the ability to specifically bind a particular antigen, affinity of antigen-binding (e.g., high or low affinity), avidity of antigen-binding (e.g., high or low avidity), on-rate, off-rate, effector functions, such as the ability to promote antigen neutralization or clearance, virus neutralization, and in vivo activities, such as the ability to prevent infection or invasion of a pathogen, or to promote clearance, or to penetrate a particular tissue or fluid or cell in the body. Activity can be assessed in vitro or in vivo using recognized assays, such as ELISA, flow cytometry, surface plasmon resonance or equivalent assays to measure on- or off-rate, immunohistochemistry and immunofluorescence histology and microscopy, cell-based assays, flow cytometry and binding assays (e.g., panning assays).

As used herein, "bind," "bound" or grammatical variations thereof refers to the participation of a molecule in any attractive interaction with another molecule, resulting in a stable association in which the two molecules are in close proximity to one another. Binding includes, but is not limited to, non-covalent bonds, covalent bonds (such as reversible and irreversible covalent bonds), and includes interactions between molecules such as, but not limited to, proteins, nucleic acids, carbohydrates, lipids, and small molecules, such as chemical compounds including drugs.

As used herein, "antibody" refers to immunoglobulins and immunoglobulin fragments, whether natural or partially or wholly synthetically, such as recombinantly produced, including any fragment thereof containing at least a portion of the variable heavy chain and light region of the immunoglobulin molecule that is sufficient to form an antigen binding site and, when assembled, to specifically bind an antigen. Hence, an antibody includes any protein having a binding domain that is homologous or substantially homologous to an immunoglobulin antigen-binding domain (antibody combining site). For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g., heavy chains include, but are not limited to, VH chains, VH-CH1 chains and VH-CH1-CH2-CH3 chains), and each light chain can be a full-length light chain or a portion thereof sufficient to form an antigen binding site (e.g., light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region.

For purposes herein, the term antibody includes full-length antibodies and portions thereof including antibody fragments, such as anti-EGFR antibody fragments. Antibody fragments, include, but are not limited to, Fab fragments, Fab' fragments, $F(ab)_2$ fragments, Fv fragments, disulfide-linked Fvs (dsFv), Fd fragments, Fd' fragments, single-chain Fvs (scFv), single-chain Fabs (scFab), diabodies, anti-idiotypic (anti-Id) antibodies, or antigen-binding fragments of any of the above. Antibody also includes synthetic antibodies, recombinantly produced antibodies, multispecific antibodies (e.g., bispecific antibodies), human antibodies, non-human antibodies, humanized antibodies, chimeric antibodies, and intrabodies. Antibodies provided herein include members of any immunoglobulin class (e.g., IgG, IgM, IgD, IgE, IgA and IgY), any subclass (e.g., IgG1, IgG2, IgG3, IgG4, IgA1 and IgA2) or sub-subclass (e.g., IgG2a and IgG2b).

As used herein, "nucleic acid" refers to at least two linked nucleotides or nucleotide derivatives, including a deoxyribonucleic acid (DNA) and a ribonucleic acid (RNA), joined together, typically by phosphodiester linkages. Also included in the term "nucleic acid" are analogs of nucleic acids such as peptide nucleic acid (PNA), phosphorothioate DNA, and other such analogs and derivatives or combinations thereof. Nucleic acids also include DNA and RNA derivatives containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). The term also includes, as equivalents, derivatives, variants and analogs of either RNA or DNA made from nucleotide analogs, single (sense or antisense) and double-stranded nucleic acids. Deoxyribonucleotides include deoxyadenosine, deoxycytidine, deoxyguanosine and deoxythymidine. For RNA, the uracil base is uridine.

As used herein, an isolated nucleic acid molecule is one which is separated from other nucleic acid molecules which are present in the natural source of the nucleic acid molecule. An "isolated" nucleic acid molecule, such as a cDNA molecule, can be substantially free of other cellular material, or culture medium when produced by recombinant techniques, or substantially free of chemical precursors or other chemicals when chemically synthesized. Exemplary isolated nucleic acid molecules provided herein include isolated nucleic acid molecules encoding an antibody or antigen-binding fragments provided.

As used herein, "operably linked" with reference to nucleic acid sequences, regions, elements or domains means that the nucleic acid regions are functionally related to each other. For example, a nucleic acid encoding a leader peptide can be operably linked to a nucleic acid encoding a polypeptide, whereby the nucleic acids can be transcribed and translated to express a functional fusion protein, wherein the leader peptide effects secretion of the fusion polypeptide. In some instances, the nucleic acid encoding a first polypeptide (e.g., a leader peptide) is operably linked to a nucleic acid encoding a second polypeptide and the nucleic acids are transcribed as a single mRNA transcript, but translation of the mRNA transcript can result in one of two polypeptides being expressed. For example, an amber stop codon can be located between the nucleic acid encoding the first polypeptide and the nucleic acid encoding the second polypeptide, such that, when introduced into a partial amber suppressor cell, the resulting single mRNA transcript can be translated to produce either a fusion protein containing the first and second polypeptides, or can be translated to produce only the first polypeptide. In another example, a promoter can be operably linked to nucleic acid encoding a polypeptide, whereby the promoter regulates or mediates the transcription of the nucleic acid.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, "polypeptide" refers to two or more amino acids covalently joined. The terms "polypeptide" and "protein" are used interchangeably herein.

As used herein, a "peptide" refers to a polypeptide that is from 2 to about or 40 amino acids in length.

As used herein, an "amino acid" is an organic compound containing an amino group and a carboxylic acid group. A polypeptide contains two or more amino acids. For purposes herein, amino acids contained in the antibodies provided include the twenty naturally-occurring amino acids (see Table below), non-natural amino acids, and amino acid analogs (e.g., amino acids wherein the α-carbon has a side chain). As used herein, the amino acids, which occur in the various amino acid sequences of polypeptides appearing herein, are identified according to their well-known, three-letter or one-letter abbreviations (see Table below). The nucleotides, which occur in the various nucleic acid molecules and fragments, are designated with the standard single-letter designations used routinely in the art.

As used herein, "amino acid residue" refers to an amino acid formed upon chemical digestion (hydrolysis) of a polypeptide at its peptide linkages. The amino acid residues described herein are generally in the "L" isomeric form. Residues in the "D" isomeric form can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.,* 243:3557-59 (1968) and adopted at 37 C.F.R. §§ 1.821-1.822, abbreviations for amino acid residues are shown in the following Table:

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glutamic Acid and/or Glutamine |
| W | Trp | Tryptophan |
| R | Arg | Arginine |
| D | Asp | Aspartic acid |
| N | Asn | Asparagine |
| B | Asx | Aspartic Acid and/or Asparagine |
| C | Cys | Cysteine |
| X | Xaa | Unknown or other |

All sequences of amino acid residues represented herein by a formula have a left to right orientation in the conventional direction of amino-terminus to carboxyl-terminus. The phrase "amino acid residue" is defined to include the amino acids listed in the above Table of Correspondence, modified, non-natural and unusual amino acids. A dash at the beginning or end of an amino acid residue sequence indicates a peptide bond to a further sequence of one or more amino acid residues or to an amino-terminal group such as $NH_2$ or to a carboxyl-terminal group such as COOH.

In a peptide or protein, suitable conservative substitutions of amino acids are known to those of skill in the art and generally can be made without altering a biological activity of a resulting molecule. Those of skill in the art recognize that, in general, single amino acid substitutions in non-essential regions of a polypeptide do not substantially alter biological activity (see, e.g., Watson et al., *Molecular Biology of the Gene,* 4th Edition, 1987, The Benjamin/Cummings Pub. Co., p. 224).

Such substitutions, such as in the gain-of-function mutations described and provided herein, can be made in accordance with the exemplary substitutions set forth in the following Table:

| Exemplary conservative amino acid substitutions | |
|---|---|
| Original residue | Exemplary Conservative substitution(s) |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with other known conservative or non-conservative substitutions.

As used herein, "naturally occurring amino acids" refer to the 20 L-amino acids that occur in polypeptides.

As used herein, the term "non-natural amino acid" refers to an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally occurring amino acids and include, but are not limited to, the D-stereoisomers of amino acids. Exemplary non-natural amino acids are known to those of skill in the art, and include, but are not limited to, 2-Aminoadipic acid (Aad), 3-Aminoadipic acid (bAad), β-alanine/β-Amino-propionic acid (Bala), 2-Aminobutyric acid (Abu), 4-Aminobutyric acid/piperidinic acid (4Abu), 6-Aminocaproic acid (Acp), 2-Aminoheptanoic acid (Ahe), 2-Aminoisobutyric acid (Aib), 3-Aminoisobutyric acid (Baib), 2-Aminopimelic acid (Apm), 2,4-Diaminobutyric acid (Dbu), Desmosine (Des), 2,2'-Diaminopimelic acid (Dpm), 2,3-Diaminopropionic acid (Dpr), N-Ethylglycine (EtGly), N-Ethyl asparagine (EtAsn), Hydroxylysine (Hyl), allo-Hydroxylysine (Ahyl), 3-Hydroxyproline (3Hyp), 4-Hydroxyproline (4Hyp), Isodesmosine (Ide), allo-Isoleucine (Aile), N-Methylglycine, sarcosine (MeGly), N-Methylisoleucine (MeIle), 6-N-Methyllysine (MeLys), N-Methylvaline (MeVal), Norvaline (Nva), Norleucine (Nle), and Ornithine (Orn).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 20 nucleotides in length.

As used herein, production by recombinant methods refers means the use of the well-known methods of molecular biology for expressing proteins encoded by cloned DNA.

As used herein, "heterologous nucleic acid" is nucleic acid that encodes products (i.e., RNA and/or proteins) that are not normally produced in vivo by the cell in which it is expressed, or nucleic acid that is in a locus in which it does not normally occur, or that mediates or encodes mediators that alter expression of endogenous nucleic acid, such as DNA, by affecting transcription, translation, or other regulatable biochemical processes. Heterologous nucleic acid, such as DNA, also is referred to as foreign nucleic acid. Any nucleic acid, such as DNA, that one of skill in the art would recognize or consider as heterologous or foreign to the cell in which it is expressed, is herein encompassed by heterologous nucleic acid; heterologous nucleic acid includes exogenously added nucleic acid that is also expressed endogenously. Heterologous nucleic acid is generally not endogenous to the cell into which it is introduced, but has been obtained from another cell or prepared synthetically or is introduced into a genomic locus in which it does not occur naturally, or its expression is under the control of regulatory sequences or a sequence that differs from the natural regulatory sequence or sequences.

Examples of heterologous nucleic acid herein include, but are not limited to, nucleic acid that encodes a protein in a DNA/RNA sensor pathway or a gain-of-function variant thereof, or an immunostimulatory protein, such as a cytokine, that confers or contributes to anti-tumor immunity in the tumor microenvironment. In the immunostimulatory bacteria, the heterologous nucleic acid generally is encoded on the introduced plasmid, but it can be introduced into the genome of the bacterium, such as a promoter that alters expression of a bacterial product. Heterologous nucleic acid, such as DNA, includes nucleic acid that can, in some manner, mediate expression of DNA that encodes a therapeutic product, or it can encode a product, such as a peptide or RNA, that in some manner mediates, directly or indirectly, expression of a therapeutic product.

As used herein, cell therapy involves the delivery of cells to a subject to treat a disease or condition. The cells, which can be allogeneic or autologous, are modified ex vivo, such as by infection of cells with immunostimulatory bacteria provided herein, so that they deliver or express products when introduced to a subject.

As used herein, genetic therapy involves the transfer of heterologous nucleic acid, such as DNA, into certain cells, such as target cells, of a mammal, particularly a human, with a disorder or condition for which such therapy is sought. The nucleic acid, such as DNA, is introduced into the selected target cells in a manner such that the heterologous nucleic acid, such as DNA, is expressed and a therapeutic product(s) encoded thereby is produced. Genetic therapy can also be used to deliver nucleic acid encoding a gene product that replaces a defective gene or supplements a gene product produced by the mammal or the cell in which it is introduced. The introduced nucleic acid can encode a therapeutic compound, such as a growth factor or inhibitor thereof, or a tumor necrosis factor or inhibitor thereof, such as a receptor thereof, that is not normally produced in the mammalian host or that is not produced in therapeutically effective amounts or at a therapeutically useful time. The heterologous nucleic acid, such as DNA, encoding the therapeutic product, can be modified prior to introduction into the cells of the afflicted host in order to enhance or otherwise alter the product or expression thereof. Genetic therapy can also involve delivery of an inhibitor or repressor or other modulator of gene expression.

As used herein, "expression" refers to the process by which polypeptides are produced by transcription and translation of polynucleotides. The level of expression of a polypeptide can be assessed using any method known in art, including, for example, methods of determining the amount of the polypeptide produced from the host cell. Such methods can include, but are not limited to, quantitation of the polypeptide in the cell lysate by ELISA, Coomassie blue staining following gel electrophoresis, Lowry protein assay and Bradford protein assay.

As used herein, a "host cell" is a cell that is used to receive, maintain, reproduce and/or amplify a vector. A host cell also can be used to express the polypeptide encoded by the vector. The nucleic acid contained in the vector is replicated when the host cell divides, thereby amplifying the nucleic acids.

As used herein, a "vector" is a replicable nucleic acid from which one or more heterologous proteins, can be expressed when the vector is transformed into an appropriate host cell. Reference to a vector includes those vectors into which a nucleic acid encoding a polypeptide or fragment thereof can be introduced, typically by restriction digest and ligation. Reference to a vector also includes those vectors that contain nucleic acid encoding a polypeptide, such as a modified anti-EGFR antibody. The vector is used to introduce the nucleic acid encoding the polypeptide into the host cell for amplification of the nucleic acid or for expression/display of the polypeptide encoded by the nucleic acid. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well-known to those of skill in the art. A vector also includes "virus vectors" or "viral vectors." Viral vectors are engineered viruses that are operatively linked to exogenous genes to transfer (as vehicles or shuttles) the exogenous genes into cells.

As used herein, an "expression vector" includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well-known to those of skill in the art and include those that are replicable in eukaryotic cells and/or prokaryotic cells and those that remain episomal or those which integrate into the host cell genome.

As used herein, "primary sequence" refers to the sequence of amino acid residues in a polypeptide or the sequence of nucleotides in a nucleic acid molecule.

As used herein, "sequence identity" refers to the number of identical or similar amino acids or nucleotide bases in a comparison between a test and a reference polypeptide or polynucleotide. Sequence identity can be determined by sequence alignment of nucleic acid or protein sequences to identify regions of similarity or identity. For purposes herein, sequence identity is generally determined by alignment to identify identical residues. The alignment can be local or global. Matches, mismatches and gaps can be identified between compared sequences. Gaps are null amino acids or nucleotides inserted between the residues of aligned sequences so that identical or similar characters are aligned. Generally, there can be internal and terminal gaps. When using gap penalties, sequence identity can be determined with no penalty for end gaps (e.g., terminal gaps are not penalized). Alternatively, sequence identity can be determined without taking into account gaps as the number of identical positions/length of the total aligned sequence×100.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences will be taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. (1970) *J Mol. Biol.* 48: 443). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequences, but only aligns those portions of the sequences that share similarity or identity. Hence, a local alignment determines if sub-segments of one sequence are present in another sequence. If there is no similarity, no alignment will be returned. Local alignment algorithms include BLAST or Smith-Waterman algorithm (*Adv. Appl. Math.* 2: 482 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

For purposes herein, sequence identity can be determined by standard alignment algorithm programs used with default gap penalties established by each supplier. Default parameters for the GAP program can include: (1) a unary comparison matrix (containing a value of 1 for identities and 0 for non-identities) and the weighted comparison matrix of Gribskov et al. (1986) *Nucl. Acids Res.* 14: 6745, as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Whether any two nucleic acid molecules have nucleotide sequences or any two polypeptides have amino acid sequences that are at least 80%, 85%, 90%, 95%, 96%, 97%, 98% or 99% "identical," or other similar variations reciting a percent identity, can be determined using known computer algorithms based on local or global alignment (see e.g., wikipedia.org/wiki/Sequence_alignment_software, providing links to dozens of known and publicly available alignment databases and programs). Generally, for purposes herein sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and program from Xiaoqui Huang available at deepc2.psi.iastate.edu/aat/align/align.html. Typically, the full-length sequence of each of the compared polypeptides or nucleotides is aligned across the full-length of each sequence in a global alignment. Local alignment also can be used when the sequences being compared are substantially the same length.

Therefore, as used herein, the term "identity" represents a comparison or alignment between a test and a reference polypeptide or polynucleotide. In one non-limiting example, "at least 90% identical to" refers to percent identities from 90 to 100% relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differ from those of the reference polypeptide. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences also can be due to deletions or truncations of amino acid residues. Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein, "disease or disorder" refers to a pathological condition in an organism resulting from a cause or condition including, but not limited to, infections, acquired conditions, and genetic conditions, and that is characterized by identifiable symptoms.

As used herein, "treating" a subject with a disease or condition means that the subject's symptoms are partially or totally alleviated, or remain static following treatment.

As used herein, treatment refers to any effects that ameliorate symptoms of a disease or disorder. Treatment encompasses prophylaxis, therapy and/or cure. Treatment also encompasses any pharmaceutical use of any immunostimulatory bacterium or composition provided herein.

As used herein, prophylaxis refers to prevention of a potential disease and/or a prevention of worsening of symptoms or progression of a disease.

As used herein, "prevention" or prophylaxis, and grammatically equivalent forms thereof, refers to methods in which the risk or probability of developing a disease or condition is reduced.

As used herein, a "pharmaceutically effective agent" includes any therapeutic agent or bioactive agents, including, but not limited to, for example, anesthetics, vasoconstrictors, dispersing agents, and conventional therapeutic drugs, including small molecule drugs and therapeutic proteins.

As used herein, a "therapeutic effect" means an effect resulting from treatment of a subject that alters, typically improves or ameliorates, the symptoms of a disease or condition or that cures a disease or condition.

As used herein, a "therapeutically effective amount" or a "therapeutically effective dose" refers to the quantity of an agent, compound, material, or composition containing a compound that is at least sufficient to produce a therapeutic effect following administration to a subject. Hence, it is the quantity necessary for preventing, curing, ameliorating, arresting or partially arresting a symptom of a disease or disorder.

As used herein, "therapeutic efficacy" refers to the ability of an agent, compound, material, or composition containing a compound to produce a therapeutic effect in a subject to whom the agent, compound, material, or composition containing a compound has been administered.

As used herein, a "prophylactically effective amount" or a "prophylactically effective dose" refers to the quantity of an agent, compound, material, or composition containing a compound that when administered to a subject, will have the intended prophylactic effect, e.g., preventing or delaying the onset, or reoccurrence, of disease or symptoms, reducing the likelihood of the onset, or reoccurrence, of disease or symptoms, or reducing the incidence of viral infection. The full prophylactic effect does not necessarily occur by administration of one dose, and can occur only after administration of a series of doses. Thus, a prophylactically effective amount can be administered in one or more administrations.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, an "anti-cancer agent" refers to any agent that is destructive or toxic to malignant cells and tissues. For example, anti-cancer agents include agents that kill cancer cells or otherwise inhibit or impair the growth of tumors or cancer cells. Exemplary anti-cancer agents are chemotherapeutic agents.

As used herein "therapeutic activity" refers to the in vivo activity of a therapeutic polypeptide. Generally, the therapeutic activity is the activity that is associated with treatment of a disease or condition.

As used herein, the term "subject" refers to an animal, including a mammal, such as a human being.

As used herein, a patient refers to a human subject.

As used herein, animal includes any animal, such as, but not limited to, primates including humans, gorillas and monkeys; rodents, such as mice and rats; fowl, such as chickens; ruminants, such as goats, cows, deer, and sheep; and pigs and other animals. Non-human animals exclude humans as the contemplated animal. The polypeptides provided herein are from any source, animal, plant, prokaryotic and fungal. Most polypeptides are of animal origin, including mammalian origin.

As used herein, a "composition" refers to any mixture. It can be a solution, suspension, liquid, powder, paste, aqueous, non-aqueous or any combination thereof.

As used herein, a "combination" refers to any association between or among two or more items. The combination can be two or more separate items, such as two compositions or two collections, a mixture thereof, such as a single mixture of the two or more items, or any variation thereof. The elements of a combination are generally functionally associated or related.

As used herein, combination therapy refers to administration of two or more different therapeutics. The different therapeutic agents can be provided and administered separately, sequentially, intermittently, or can be provided in a single composition.

As used herein, a kit is a packaged combination that optionally includes other elements, such as additional reagents and instructions for use of the combination or elements thereof, for a purpose including, but not limited to, activation, administration, diagnosis, and assessment of a biological activity or property.

As used herein, a "unit dose form" refers to physically discrete units suitable for human and animal subjects and packaged individually as is known in the art.

As used herein, a "single dosage formulation" refers to a formulation for direct administration.

As used herein, a multi-dose formulation refers to a formulation that contains multiple doses of a therapeutic agent and that can be directly administered to provide several single doses of the therapeutic agent. The doses can be administered over the course of minutes, hours, weeks, days or months. Multi-dose formulations can allow dose adjustment, dose-pooling and/or dose-splitting. Because multi-dose formulations are used over time, they generally contain one or more preservatives to prevent microbial growth.

As used herein, an "article of manufacture" is a product that is made and sold. As used throughout this application, the term is intended to encompass any of the compositions provided herein contained in articles of packaging.

As used herein, a "fluid" refers to any composition that can flow. Fluids thus encompass compositions that are in the form of semi-solids, pastes, solutions, aqueous mixtures, gels, lotions, creams and other such compositions.

As used herein, an isolated or purified polypeptide or protein (e.g., an isolated antibody or antigen-binding fragment thereof) or biologically-active portion thereof (e.g., an isolated antigen-binding fragment) is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification does not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound. As used herein, a "cellular extract" or "lysate" refers to a preparation or fraction which is made from a lysed or disrupted cell.

As used herein, a "control" refers to a sample that is substantially identical to the test sample, except that it is not treated with a test parameter, or, if it is a plasma sample, it can be from a normal volunteer not affected with the condition of interest. A control also can be an internal control.

As used herein, the singular forms "a," "an" and "the" include plural referents unless the context clearly dictates otherwise. Thus, for example, reference to a polypeptide, comprising "an immunoglobulin domain" includes polypeptides with one or a plurality of immunoglobulin domains.

As used herein, the term "or" is used to mean "and/or" unless explicitly indicated to refer to alternatives only or the alternatives are mutually exclusive.

As used herein, ranges and amounts can be expressed as "about" a particular value or range. About also includes the exact amount. Hence "about 5 amino acids" means "about 5 amino acids" and also "5 amino acids."

As used herein, "optional" or "optionally" means that the subsequently described event or circumstance does or does not occur and that the description includes instances where said event or circumstance occurs and instances where it does not. For example, an optionally variant portion means that the portion is variant or non-variant.

As used herein, the abbreviations for any protective groups, amino acids and other compounds, are, unless indicated otherwise, in accord with their common usage, recognized abbreviations, or the IUPAC-IUB Commission on Biochemical Nomenclature (see, *Biochem.* (1972) 11(9): 1726-1732).

For clarity of disclosure, and not by way of limitation, the detailed description is divided into the subsections that follow.

B. OVERVIEW OF THE IMMUNOSTIMULATORY BACTERIA

Provided are modified bacteria, called immunostimulatory bacteria herein that accumulate and/or replicate in tumors and encode inhibitory RNAs, such as designed shRNAs and designed microRNAs, that target genes whose inhibition, suppression or silencing effects tumor therapy, upon expression of the RNAs in the treated subject. Strains of bacteria for modification are any suitable for therapeutic use. The modified immunostimulatory bacteria provided herein are for use and for methods for treating cancer. The bacteria are modified for such uses and methods.

The immunostimulatory bacteria provided herein are modified by deletion or modification of bacterial genes to attenuate their inflammatory responses, and are modified to enhance anti-tumor immune responses in hosts treated with the bacteria. For example, the plasmids encoding therapeutic, such as anti-tumor, products in the host are included in the bacteria, and the bacteria can be auxotrophic for adenosine. Attenuation of the inflammatory response to the bacteria can be effected by deletion of the msbB gene, which decreases TNF-alpha in the host, and/or knocking out flagellin genes. The bacteria are modified to stimulate host anti-tumor activity, for example, by adding plasmids encoding immunostimulatory proteins, STING proteins, variant STING proteins, and proteins that target host immune checkpoints, and by adding nucleic acid with CpGs.

Bacterial strains can be attenuated strains or strains that are attenuated by standard methods or that by virtue of the modifications provided herein are attenuated in that their ability to colonize is limited primarily to immunoprivileged tissues and organs, particularly immune and tumor cells, including solid tumors. For purposes herein, the bacteria are not necessarily attenuated per se, but rather, contain modification(s), such as genomic modifications, that limit or alter the cells that are infected by the bacteria. Bacteria include, but are not limited to, for example, strains of *Salmonella, Shigella, Listeria, E. coli*, and Bifidobacteriae. For example, species include *Shigella sonnei, Shigella flexneri, Shigella dysenteriae, Listeria monocytogenes, Salmonella typhi, Salmonella typhimurium, Salmonella gallinarum*, and *Salmonella enteritidis*. Other suitable bacterial species include *Rickettsia, Klebsiella, Bordetella, Neisseria, Aeromonas, Francisella, Corynebacterium, Citrobacter, Chlamydia, Haemophilus, Brucella, Mycobacterium, Mycoplasma, Legionella, Rhodococcus, Pseudomonas, Helicobacter, Vibrio, Bacillus*, and *Erysipelothrix*. For example, *Rickettsia rickettsiae, Rickettsia prowazekii, Rickettsia tsutsugamushi, Rickettsia mooseri, Rickettsia sibirica, Bordetella bronchiseptica, Neisseria meningitidis, Neisseria gonorrhoeae, Aeromonas eucrenophila, Aeromonas salmonicida, Francisella tularensis, Corynebacterium pseudotuberculosis, Citrobacter freundii, Chlamydia pneumoniae, Haemophilus somnus, Brucella abortus, Mycobacterium intracellulare, Legionella pneumophila, Rhodococcus equi, Pseudomonas aeruginosa, Helicobacter mustelae, Vibrio cholerae, Bacillus subtilis, Erysipelothrix rhusiopathiae, Yersinia enterocolitica, Rochalimaea quintana*, and *Agrobacterium tumerfacium*.

The bacteria accumulate by virtue of one or more properties, including, diffusion, migration and chemotaxis to immunoprivileged tissues or organs or environments, environments that provide nutrients or other molecules for which they are auxotrophic and/or environments that contain replicating cells that provide environments for entry and replication of bacteria. The immunostimulatory bacteria provided herein and species that effect such therapy include species of *Salmonella, Listeria*, and *E. coli*. The bacteria contain plasmids that encode a therapeutic product or products expressed under control of a eukaryotic promoter, such as an RNA polymerase (RNAP) II or III promoter. Typically, RNAPIII (also referred to as POLIII) promoters are constitutive, and RNAPII (also referred to as POLII) can be regulated. Where a plurality of products are encoded, expression of each can be under control of different promoters.

Among the bacteria provided herein, are bacteria that are modified so that they are auxotrophic for adenosine. This can be achieved by modification or deletion of genes involved in purine synthesis, metabolism, or transport. For example, disruption of the tsx gene in *Salmonella* species, such as *Salmonella typhi*, results in adenosine auxotrophy. Adenosine is immunosuppressive and accumulates to high concentrations in tumors; auxotrophy for adenosine improves the anti-tumor activity of the bacteria because the bacteria selectively replicate in tissues rich in adenosine.

Also provided are bacteria that are modified so that they have a defective asd gene. These bacteria for use in vivo are modified to include carrying a functional asd gene on the introduced plasmid; this maintains selection for the plasmid so that an antibiotic-based plasmid maintenance/selection system is not needed. Also provided is the use of asd defective strains that do not contain a functional asd gene on a plasmid and are thus engineered to be autolytic in the host.

Also provided are bacteria that are modified so that they are incapable of producing flagella. This can be achieved by modifying the bacteria by means of deleting the genes that encode the flagellin subunits. The modified bacteria lacking flagellin are less inflammatory and therefore better tolerated and induce a more potent anti-tumor response.

Also provided are bacteria that are modified to produce listeriolysin O, which improves plasmid delivery in phagocytic cells.

Also provided are bacteria modified to carry a low copy, CpG-containing plasmid. The plasmid further can include other modifications.

The bacteria also can be modified to grow in a manner such that the bacteria, if a *Salmonella* species, expresses less of the toxic SPI-1 (*Salmonella* pathogenicity island-1) genes. In *Salmonella*, genes responsible for virulence, invasion, survival, and extra intestinal spread are located in *Salmonella* pathogenicity islands (SPIs).

The bacteria can be further modified for other desirable traits, including for selection of plasmid maintenance, particularly for selection without antibiotics, for preparation of the strains. The immunostimulatory bacteria optionally can encode therapeutic polypeptides, including anti-tumor therapeutic polypeptides and agents.

Exemplary of the immunostimulatory bacteria provided herein are species of *Salmonella*. Exemplary of bacteria for modification as described herein are engineered strains of *Salmonella typhimurium*, such as strain YS1646 (deposited under the accession number ATCC 202165; see, also, International PCT Application Publication No. WO 99/13053, also referred to as VNP20009) that is engineered with plasmids to complement an asd gene knockout and antibiotic-free plasmid maintenance.

Modified immunostimulatory bacterial strains that are rendered auxotrophic for adenosine are provided herein as are pharmaceutical compositions containing such strains formulated for administration to a subject, such as a human, for use in methods of treating tumors and cancers.

The engineered immunostimulatory bacteria provided herein contain multiple synergistic modalities to induce immune re-activation of cold tumors and to promote tumor antigen-specific immune responses, while inhibiting immune checkpoint pathways that the tumor utilizes to subvert and evade durable anti-tumor immunity. Improved tumor targeting through adenosine auxotrophy and enhanced vascular disruption have improved potency, while localizing the inflammation to limit systemic cytokine exposure and the autoimmune toxicities observed with other immunotherapy modalities. Exemplary of the bacteria so-modified are *S. typhimurium* strains, including such modifications of the strain YS1646, particularly asd$^{-}$ strains, and of wild-type strains.

C. CANCER IMMUNOTHERAPEUTICS

The immunosuppressive milieu found within the tumor microenvironment (TME) is a driver of tumor initiation and progression. Cancers emerge after the immune system fails to control and contain tumors. Multiple tumor-specific mechanisms create tumor environments wherein the immune system is forced to tolerate tumors and their cells instead of eliminating them. The goal of cancer immunotherapy is to rescue the immune system's natural ability to eliminate tumors.

1. Immunotherapies

Several clinical cancer immunotherapies have sought to perturb the balance of immune suppression towards anti-tumor immunity. Strategies to stimulate immunity through directly administering cytokines such as IL-2 and IFN-α have seen modest clinical responses in a minority of patients, while inducing serious systemic inflammation-related toxicities (Sharma et al. (2011) *Nat. Rev. Cancer* 11:805-812). The immune system has evolved several checks and balances to limit autoimmunity, such as upregulation of programmed cell death protein 1 (PD-1) on T cells and its binding to its cognate ligand, programmed death-ligand 1 (PD-L1), which is expressed on both antigen presenting cells (APCs) and tumor cells. The binding of PD-L1 to PD-1 interferes with $CD8^+$ T cell signaling pathways, impairing the proliferation and effector function of $CD8^+$ T cells, and inducing T cell tolerance. PD-1 and PD-L1 are two examples of numerous inhibitory "immune checkpoints," which function by downregulating immune responses. Other inhibitory immune checkpoints include cytotoxic T-lymphocyte-associated protein 4 (CTLA-4), signal regulatory protein α (SIRPα), V-domain Ig suppressor of T cell activation (VISTA), programmed death-ligand 2 (PD-L2), indoleamine 2,3-dioxygenase (IDO) 1 and 2, lymphocyte-activation gene 3 (LAG3), Galectin-9, T cell immunoreceptor with Ig and ITIM domains (TIGIT), T cell immunoglobulin and mucin-domain containing-3 (TIM-3, also known as hepatitis A virus cellular receptor 2 (HAVCR2)), herpesvirus entry mediator (HVEM), CD39, CD73, B7-H3 (also known as CD276), B7-H4, CD47, CD48, CD80 (B7-1), CD86 (B7-2), CD155, CD160, CD244 (2B4), B- and T-lymphocyte attenuator (BTLA, or CD272) and carcinoembryonic antigen-related cell adhesion molecule 1 (CEACAM1, or CD66a).

Antibodies designed to block immune checkpoints, such as anti-PD-1 (for example, pembrolizumab, nivolumab) and anti-PD-L1 (for example, atezolizumab, avelumab, durvalumab), have had durable success in preventing T cell anergy and breaking immune tolerance. Only a fraction of treated patients demonstrate clinical benefit, and those that do often present with autoimmune-related toxicities (see, e.g., Ribas (2015) *N. Engl. J. Med.* 373:1490-1492; Topalian et al. (2012) *N. Engl. J. Med.* 366:2443-2454). This is further evidence for the need for therapies, provided herein, that are more effective and less toxic.

Another checkpoint blockade strategy inhibits the induction of CTLA-4 on T cells, which binds to and inhibits co-stimulatory receptors on APCs, such as CD80 or CD86, out-competing the co-stimulatory cluster differentiation 28 (CD28), which binds the same receptors, but with a lower affinity. This blocks the stimulatory signal from CD28, while the inhibitory signal from CTLA-4 is transmitted, preventing T cell activation (see, Phan et al. (2003) *Proc. Natl. Acad. Sci. U.S.A.* 100:8372-8377). Anti-CTLA-4 therapy (for example, ipilimumab) has had clinical success and durability in some patients, whilst exhibiting an even greater incidence of severe immune-related adverse events (see, e.g., Hodi et al. (2010) *N. Engl. J Med.* 363:711-723; Schadendorf et al. (2015) *J Clin. Oncol.* 33:1889-1894). It also has been shown that tumors develop resistance to anti-immune checkpoint antibodies, highlighting the need for more durable anticancer therapies, such as those provided herein.

2. Adoptive Immunotherapies

In seeking to reactivate a cold tumor to become more immunogenic, a class of immunotherapies known as adoptive cell therapy (ACT) encompasses a variety of strategies to harness immune cells and reprogram them to have anti-tumor activity (Zielinski et al. (2011) *Immunol. Rev.* 240:40-51). Dendritic cell-based therapies introduce genetically engineered dendritic cells (DCs) with more immune-stimulatory properties. These therapies have not been successful because they fail to break immune tolerance to cancer (see, e.g., Rosenberg et al. (2004) *Nat. Med.* 12:1279). A method using whole irradiated tumor cells containing endogenous tumor antigens and granulocyte macrophage colony-stimulating factor (GM-CSF) to stimulate DC recruitment, known as GVAX, similarly failed in the clinic due to the lack of ability to break tumor tolerance (Copier et al. (2010) *Curr. Opin. Mol. Ther.* 12:14-20). A separate autologous cell-based therapy, Sipuleucel-T (Provenge), was FDA approved in 2010 for castration-resistant prostate cancer. It utilizes APCs retrieved from the patient and re-armed to express prostatic acid phosphatase (PAP) antigen to stimulate a T cell response, then re-introduced following lymphablation. Unfortunately, its broader adoption is limited by low observed objective response rates and high costs, and its use is limited only to the early stages of prostate cancer (Anassi et al. (2011) *P T.* 36(4):197-202). Similarly, autologous T cell therapies (ATCs) harvest a patient's own T cells and reactivate them ex vivo to overcome tumor tolerance, then reintroduce them to the patient following lymphablation. ATCs have had limited clinical success, and only in melanoma, while generating serious safety and feasibility issues that limit their utility (Yee et al. (2013) *Clin. Cancer Res.* 19:4550-4552).

Chimeric antigen receptor T cell (CAR-T) therapies are T cells harvested from patients that have been re-engineered to express a fusion protein between the T cell receptor and an antibody Ig variable extracellular domain. This confers upon them the antigen-recognition properties of antibodies with the cytolytic properties of activated T cells (Sadelain (2015) *Clin. Invest.* 125:3392-400). Success has been limited to B cell and hematopoietic malignancies, at the cost of deadly immune-related adverse events (Jackson et al. (2016) *Nat. Rev. Clin. Oncol.* 13:370-383). Tumors can also mutate to escape recognition by a target antigen, including CD19 (Ruella et al., (2016) *Comput Struct Biotechnol J.* 14:357-362) and EGFRvIII (O'Rourke et al. (2017) *Sci Transl Med.* July 19; 9(399):eaaa0984), thereby fostering immune escape. While CAR-T therapies are approved in the context of hematological malignancies, they face a significant hurdle for feasibility to treat solid tumors: overcoming the highly immunosuppressive nature of the solid tumor microenvironment. A number of additional modifications to existing CAR-T therapies are needed to potentially provide feasibility against solid tumors (Kakarla, et al. (2014) *Cancer J.* March-April; 20(2): 151-155).

3. Cancer Vaccines and Oncolytic Viruses

Cold tumors lack T cell and dendritic cell (DC) infiltration, and are non-T-cell-inflamed (Sharma et al. (2017) *Cell* 9; 168(4):707-723). In seeking to reactivate a cold tumor to become more immunogenic, another class of immunotherapies harness microorganisms that can accumulate in tumors, either naturally or by virtue of engineering. These include viruses designed to stimulate the immune system to express tumor antigens, thereby activating and reprogramming the immune system to reject the tumor. Virally-based cancer vaccines have failed clinically for a number of factors, including pre-existing or acquired immunity to the viral vector itself, as well as a lack of sufficient immunogenicity to the expressed tumor antigens (Larocca et al. (2011) *Cancer J.* 17(5):359-371). Lack of proper adjuvant activation of APCs has also hampered other non-viral vector cancer vaccines, such as DNA vaccines. Oncolytic viruses preferentially replicate in dividing tumor cells over healthy tissue, whereupon subsequent tumor cell lysis leads to immunogenic tumor cell death and further viral dissemination. The oncolytic virus Talimogene laherparepvec (T-VEC), which uses a modified herpes simplex virus in combination with the DC-recruiting cytokine GM-CSF, is FDA approved for metastatic melanoma (Bastin et al. (2016) *Biomedicines* 4(3):21). While demonstrating clinical benefit in some melanoma patients, and with fewer immune toxicities than with other immunotherapies, its efficacy has been limited; there is a lack of distal tumor efficacy and broader application to other tumor types. Other oncolytic virus (OV)-based vaccines, such as those utilizing paramyxovirus, reovirus and picornavirus, among others, have met with similar limitations in inducing systemic anti-tumor immunity (Chiocca et al. (2014) *Cancer Immunol. Res.* 2(4):295-300). Systemic administration of oncolytic viruses presents unique challenges. Upon IV administration, the virus is rapidly diluted, thus requiring high titers that can lead to hepatotoxicity. If pre-existing immunity exists, the virus is rapidly neutralized in the blood, and acquired immunity then restricts repeat dosing (Maroun et al. (2017) *Future Virol.* 12(4):193-213).

Of the limitations of virally-based vaccine vectors and oncolytic viruses, the greatest limitations can be the virus itself. Viral antigens have strikingly higher affinities to human T cell receptors (TCR) compared to tumor antigens (Aleksic et al. (2012) *Eur J Immunol.* 42(12):3174-3179). Tumor antigens, presented alongside of viral vector antigens by MHC-1 on the surface of even highly activated APCs, will be outcompeted for binding to TCRs, resulting in very poor antigen-specific anti-tumor immunity. A tumor-targeting immunostimulatory vector, as provided herein, that does not itself provide high affinity T cell epitopes can circumvent these limitations.

D. BACTERIAL CANCER IMMUNOTHERAPY

Provided herein are immunostimulatory bacteria that are modified so that they accumulate in tumor-resident immune cells, and do not infect epithelial or other cells. The immunostimulatory bacteria contain plasmids that encode and express, under control of a host-recognized promoter, and secrete, therapeutic products, such as immunostimulatory proteins that are part of a cytosolic DNA/RNA sensor pathway, leading to the expression of type I IFN. Thus, the immunostimulatory bacteria are cancer therapeutics that, by virtue of modification of the bacterial genome, and the encoded therapeutic product(s), deliver an immunotherapy directly to the tumor microenvironment. The bacteria and methods and uses provided herein solve prior problems encountered with other cancer immunotherapeutics. The immunostimulatory proteins that are part of a cytosolic DNA/RNA sensor pathway leading to the expression of type I IFN, in addition to expression in the immunostimulatory bacteria provided herein, can be encoded or provided in other delivery vehicles, such as exosomes, liposomes, oncolytic viruses, and gene therapy vectors.

1. Bacterial Therapies

Acute inflammation associated with microbial infection has been observationally linked with the spontaneous elimination of tumors for centuries. The recognition that bacteria have anticancer activity goes back to the 1800s, when several physicians observed regression of tumors in patients infected with *Streptococcus pyogenes*. William Coley began the first study using bacteria for the treatment of end stage cancers, and developed a vaccine composed of *S. pyogenes* and *Serratia marcescens*. This vaccine successfully was used to treat a variety of cancers, including sarcomas, carcinomas, lymphomas and melanomas. Since then, a number of bacteria, including species of *Clostridium, Mycobacterium, Bifidobacterium, Listeria*, such as, *L. monocytogenes*, and *Escherichia* species, have been studied as sources of anti-cancer vaccines (see, e.g., Published International PCT Application Nos. WO 1999/013053 and WO 2001/025399; Bermudes et al. (2002) *Curr. Opin. Drug Discov. Devel.* 5:194-199; Patyar et al. (2010) *Journal of Biomedical Science* 17:21; and Pawelek et al. (2003) *Lancet Oncol.* 4:548-556).

Bacteria can infect animal and human cells, and some possess the innate ability to deliver DNA into the cytosol of cells. Bacteria also are suitable for therapy because they can be administered orally, they propagate readily in vitro and in vivo, and they can be stored and transported in a lyophilized state. Bacterial genetics readily are manipulated, and the complete genomes for many strains have been fully characterized (Felgner et al. (2016) *mbio* 7(5):e01220-16). As a result, bacteria have been used to deliver and express a variety of genes, including those that encode cytokines, angiogenesis inhibitors, toxins and prodrug-converting enzymes. *Salmonella*, for example, has been used to express immune-stimulating molecules, such as IL-18 (Loeffler et al. (2008) *Cancer Gene Ther.* 15(12):787-794), LIGHT (Loeffler et al. (2007) *PNAS* 104(31):12879-12883), and Fas ligand (Loeffler et al. (2008) *J. Natl. Cancer Inst.* 100:1113-1116), for treating tumors. Bacterial vectors also are cheaper and easier to produce than viral vectors, and bacterial delivery is favorable over viral delivery because it can be quickly eliminated by antibiotics if necessary, rendering it a safer alternative.

To be used, however, the strains must not be pathogenic, or not pathogenic after modification, for use as a therapeutic. For example, in the treatment of cancer, the therapeutic bacterial strains must be attenuated or rendered sufficiently non-toxic so as to not cause systemic disease and/or septic shock, but still maintain some level of infectivity to effectively colonize tumors. Genetically modified bacteria have been described that are to be used as antitumor agents to elicit direct tumoricidal effects and/or to deliver tumoricidal molecules (Clairmont, et al. (2000) *J. Infect. Dis.* 181:1996-2002; Bermudes, D. et al. (2002) *Curr. Opin. Drug Discov. Devel.* 5:194-199; Zhao, M. et al. (2005) *Proc. Natl. Acad. Sci. USA* 102:755-760; Zhao, M. et al. (2006) *Cancer Res.* 66:7647-7652). Among these are bioengineered strains of *Salmonella enterica* serovar *Typhimurium* (*S. typhimurium*). These bacteria accumulate preferentially >1,000-fold greater in tumors than in normal tissues and disperse homogeneously in tumor tissues (Pawelek, J. et al. (1997) *Cancer Res.* 57:4537-4544; Low, K. B. et al. (1999) *Nat. Biotechnol.* 17:37-41). Preferential replication allows the bacteria to produce and deliver a variety of anticancer therapeutic agents at high concentrations directly within the tumor, while minimizing toxicity to normal tissues. These attenuated bacteria are safe in mice, pigs, and monkeys when administered intravenously (Zhao, M. et al. (2005) *Proc Natl*

*Acad Sci USA* 102:755-760; Zhao, M. et al. (2006) *Cancer Res* 66:7647-7652; Tjuvajev J. et al. (2001) *J. Control Release* 74:313-315; Zheng, L. et al. (2000) *Oncol. Res.* 12:127-135), and certain live attenuated *Salmonella* strains have been shown to be well tolerated after oral administration in human clinical trials (Chatfield, S. N. et al. (1992) *Biotechnology* 10:888-892; DiPetrillo, M. D. et al. (1999) *Vaccine* 18:449-459; Hohmann, E. L. et al. (1996) *J. Infect. Dis.* 173:1408-1414; Sirard, J. C. et al. (1999) *Immunol. Rev.* 171:5-26). The *S. typhimurium* phoP/phoQ operon is a typical bacterial two-component regulatory system composed of a membrane-associated sensor kinase (PhoQ) and a cytoplasmic transcriptional regulator (PhoP: Miller, S. I. et al. (1989) *Proc Natl Acad Sci USA* 86:5054-5058; Groisman, E. A. et al. (1989) *Proc Natl Acad Sci USA* 86: 7077-7081). PhoP/phoQ is required for virulence, and its deletion results in poor survival of this bacterium in macrophages and a marked attenuation in mice and humans (Miller, S. I. et al. (1989) *Proc Natl Acad Sci USA* 86:5054-5058; Groisman, E. A. et al. (1989) *Proc Natl Acad Sci USA* 86: 7077-7081; Galan, J. E. and Curtiss, R. III. (1989) *Microb Pathog* 6:433-443; Fields, P. I. et al. (1986) *Proc Natl Acad Sci USA* 83:5189-5193). PhoP/phoQ deletion strains have been employed as effective vaccine delivery vehicles (Galan, J. E. and Curtiss, R. III. (1989) *Microb Pathog* 6:433-443; Fields, P. I. et al. (1986) *Proc Natl Acad Sci USA* 83:5189-5193; Angelakopoulos, H. and Hohmann, E. L. (2000) *Infect Immun* 68:2135-2141). Attenuated Salmonellae have been used for targeted delivery of tumoricidal proteins (Bermudes, D. et al. (2002) *Curr Opin Drug Discov Devel* 5:194-199; Tjuvajev J. et al. (2001) *J Control Release* 74:313-315).

Bacterially-based cancer therapies have demonstrated limited clinical benefit. A variety of bacterial species, including *Clostridium novyi* (Dang et al. (2001) *Proc. Natl. Acad. Sci. U.S.A.* 98(26):15155-15160; U.S. Patent Publications Nos. 2017/0020931 and 2015/0147315; and U.S. Pat. Nos. 7,344,710 and 3,936,354), *Mycobacterium bovis* (U.S. Patent Publications Nos. 2015/0224151 and 2015/0071873), *Bifidobacterium bifidum* (Kimura et al. (1980) *Cancer Res.* 40:2061-2068), *Lactobacillus casei* (Yasutake et al. (1984) *Med Microbiol Immunol.* 173(3):113-125), *Listeria monocytogenes* (Le et al. (2012) *Clin. Cancer Res.* 18(3):858-868; Starks et al. (2004) *J. Immunol.* 173:420-427; U.S. Patent Publication No. 2006/0051380) and *Escherichia coli* (U.S. Pat. No. 9,320,787), have been studied as possible agents for anticancer therapy.

The *Bacillus* Calmette-Guerin (BCG) strain, for example, is approved for the treatment of bladder cancer in humans, and is more effective than intravesical chemotherapy, often being used as a first-line treatment (Gardlik et al. (2011) *Gene therapy* 18:425-431). Another approach utilizes *Listeria monocytogenes*, a live attenuated intracellular bacterium capable of inducing potent $CD8^+$ T cell priming to expressed tumor antigens in mice (Le et al. (2012) *Clin. Cancer Res.* 18(3):858-868). In a clinical trial of the *Listeria*-based vaccine incorporating the tumor antigen mesothelin, together with an allogeneic pancreatic cancer-based GVAX vaccine in a prime-boost approach, a median survival of 6.1 months was noted in patients with advanced pancreatic cancer, versus a median survival of 3.9 months for patients treated with the GVAX vaccine alone (Le et al. (2015) *J. Clin. Oncol.* 33(12):1325-1333). These results were not replicated in a larger phase 2b study, possibly pointing to the difficulties in attempting to induce immunity to a low affinity self-antigen such as mesothelin.

Bacterial strains can be modified as described herein. The strains can be attenuated or their cellular targets modified by standard methods and/or by deletion or modification of genes, and by alteration or introduction of genes that render the bacteria able to grow in vivo primarily in immunoprivileged environments, such as the TME, in tumor cells, in tumor-resident immune cells, and solid tumors. Starting strains for modification as described herein can be selected from among, for example, *Shigella, Listeria, E. coli*, Bifidobacteriae and *Salmonella*. For example, *Shigella sonnei, Shigella flexneri, Shigella dysenteriae, Listeria monocytogenes, Salmonella typhi, Salmonella typhimurium, Salmonella gallinarum*, and *Salmonella enteritidis*. Other suitable bacterial species include *Rickettsia, Klebsiella, Bordetella, Neisseria, Aeromonas, Francisella, Corynebacterium, Citrobacter, Chlamydia, Haemophilus, Brucella, Mycobacterium, Mycoplasma, Legionella, Rhodococcus, Pseudomonas, Helicobacter, Vibrio, Bacillus*, and *Erysipelothrix*. For example, *Rickettsia rickettsiae, Rickettsia prowazecki, Rickettsia tsutsugamushi, Rickettsia mooseri, Rickettsia sibirica, Bordetella bronchiseptica, Neisseria meningitidis, Neisseria gonorrhoeae, Aeromonas eucrenophila, Aeromonas salmonicida, Francisella tularensis, Corynebacterium pseudotuberculosis, Citrobacter freundii, Chlamydia pneumoniae, Haemophilus somnus, Brucella abortus, Mycobacterium intracellulare, Legionella pneumophila, Rhodococcus equi, Pseudomonas aeruginosa, Helicobacter mustelae, Vibrio cholerae, Bacillus subtilis, Erysipelothrix rhusiopathiae, Yersinia enterocolitica, Rochalimaea quintana*, and *Agrobacterium tumerfacium*. Any known therapeutic, including immunostimulatory, bacteria can be modified as described herein.

2. Comparison of the Immune Responses to Bacteria and Viruses

Bacteria, like viruses, have the advantage of being naturally immunostimulatory. Bacteria and viruses contain conserved structures known as Pathogen-Associated Molecular Patterns (PAMPs), which are sensed by host cell Pattern Recognition Receptors (PRRs). Recognition of PAMPs by PRRs triggers downstream signaling cascades that result in the induction of cytokines and chemokines, and the initiation of immune responses that lead to pathogen clearance (Iwasaki and Medzhitov (2010) *Science* 327(5963):291-295). The manner in which the innate immune system is engaged by PAMPs, and from what type of infectious agent, determines the appropriate adaptive immune response to combat the invading pathogen.

A class of PRRs known as Toll Like Receptors (TLRs) recognize PAMPs derived from bacterial and viral origins, and are located in various compartments within the cell. TLRs bind a range of ligands, including lipopolysaccharide (TLR4), lipoproteins (TLR2), flagellin (TLR5), unmethylated CpG motifs in DNA (TLR9), double-stranded RNA (TLR3), and single-stranded RNA (TLR7 and TLR8) (Akira et al. (2001) *Nat. Immunol.* 2(8):675-680; Kawai and Akira (2005) *Curr. Opin. Immunol.* 17(4):338-344). Host surveillance of *S. typhimurium* for example, is largely mediated through TLR2, TLR4 and TLR5 (Arpaia et al. (2011) *Cell* 144(5):675-688). These TLRs signal through MyD88 and TRIF adaptor molecules to mediate induction of NF-κB dependent pro-inflammatory cytokines such as TNF-α, IL-6 and IFN-γ (Pandey et. al. (2015) *Cold Spring Harb Perspect Biol* 7(1):a016246).

Another category of PRRs are the nod-like receptor (NLR) family. These receptors reside in the cytosol of host cells and recognize intracellular PAMPs. For example, *S. typhimurium* flagellin was shown to activate the NLRC4/

NAIP5 inflammasome pathway, resulting in the cleavage of caspase-1 and induction of the pro-inflammatory cytokines IL-1β and IL-18, leading to pyroptotic cell death of infected macrophages (Fink et al. (2007) *Cell Microbiol.* 9(11):2562-2570).

While engagement of TLR2, TLR4, TLR5 and the inflammasome induces pro-inflammatory cytokines that mediate bacterial clearance, they activate a predominantly NF-κB-driven signaling cascade that leads to recruitment and activation of neutrophils, macrophages and $CD4^+$ T cells, but not the DCs and $CD8^+$ T cells that are required for anti-tumor immunity (Liu et al. (2017) *Signal Transduct Target Ther.* 2:e17023). In order to activate $CD8^+$ T cell-mediated anti-tumor immunity, IRF3/IRF7-dependent type I interferon signaling is critical for DC activation and cross-presentation of tumor antigens to promote $CD8^+$ T cell priming (Diamond et al. (2011) *J Exp. Med.* 208(10):1989-2003; Fuertes et al. (2011) *J Exp. Med.* 208(10):2005-2016). Type I interferons (IFN-α, IFN-β) are the signature cytokines induced by two distinct TLR-dependent and TLR-independent signaling pathways. The TLR-dependent pathway for inducing IFN-β occurs following endocytosis of pathogens, whereby TLR3, 7, 8 and 9 detect pathogen-derived DNA and RNA elements within the endosomes. TLRs 7 and 8 recognize viral nucleosides and nucleotides, and synthetic agonists of these, such as resiquimod and imiquimod have been clinically validated (Chi et al. (2017) *Frontiers in Pharmacology* 8:304). Synthetic dsRNA, such as polyinosinic:polycytidylic acid (poly (I:C)) and poly ICLC, an analog that is formulated with poly L lysine to resist RNase digestion, is an agonist for TLR3 and MDA5 pathways and a powerful inducer of IFN-β (Caskey et al. (2011) *J. Exp. Med.* 208(12):2357-66). TLR9 detection of endosomal CpG motifs present in viral and bacterial DNA can also induce IFN-β via IRF3. Additionally, TLR4 has been shown to induce IFN-β via MyD88-independent TRIF activation of IRF3 (Owen et al. (2016) *mBio.*7:1 e02051-15). It subsequently was shown that TLR4 activation of DCs was independent of type I IFN, so the ability of TLR4 to activate DCs via type I IFN is not likely biologically relevant (Hu et al. (2015) *Proc. Natl. Acad. Sci. U.S.A.* 112(45): 13994-13999). Further, TLR4 signaling has not been shown to directly recruit or activate $CD8^+$ T cells.

Of the TLR-independent type I IFN pathways, one is mediated by host recognition of single-stranded (ss) and double-stranded (ds) RNA in the cytosol. These are sensed by RNA helicases, including retinoic acid-inducible gene I (RIG-I), melanoma differentiation-associated gene 5 (MDA-5), and through the IFN-β promoter stimulator 1 (IPS-1; also known as mitochondrial antiviral-signaling protein or MAVS) adaptor protein-mediated phosphorylation of the IRF-3 transcription factor, leading to induction of IFN-β (Ireton and Gale (2011) *Viruses* 3(6):906-919). Synthetic RIG-I-binding elements have also been discovered unintentionally in common lentiviral shRNA vectors, in the form of an AA dinucleotide sequence at the U6 promoter transcription start site. Its subsequent deletion in the plasmid prevented confounding off-target type I IFN activation (Pebernard et al. (2004) *Differentiation.* 72:103-111).

The second type of TLR-independent type I interferon induction pathway is mediated through Stimulator of Interferon Genes (STING), a cytosolic ER-resident adaptor protein that is now recognized as the central mediator for sensing cytosolic dsDNA from infectious pathogens or aberrant host cell damage (Barber (2011) *Immunol. Rev* 243(1): 99-108). STING signaling activates the TANK binding kinase (TBK1)/IRF3 axis and the NF-κB signaling axis, resulting in the induction of IFN-β and other pro-inflammatory cytokines and chemokines that strongly activate innate and adaptive immunity (Burdette et al. (2011) *Nature* 478 (7370):515-518). Sensing of cytosolic dsDNA through STING requires cyclic GMP-AMP synthase (cGAS), a host cell nucleotidyl transferase that directly binds dsDNA, and in response, synthesizes a cyclic dinucleotide (CDN) second messenger, cyclic GMP-AMP (cGAMP), which binds and activates STING (Sun et al. (2013) *Science* 339(6121):786-791; Wu et al. (2013) *Science* 339(6121):826-830). CDNs derived from bacteria such as c-di-AMP produced from intracellular *Listeria monocytogenes* can also directly bind murine STING, but only 3 of the 5 human STING alleles. Unlike the CDNs produced by bacteria, in which the two purine nucleosides are joined by a phosphate bridge with 3'-3' linkages, the internucleotide phosphate bridge in the cGAMP synthesized by mammalian cGAS is joined by a non-canonical 2'-3' linkage. These 2'-3' molecules bind to STING with 300-fold better affinity than bacterial 3'-3' CDNs, and thus, are more potent physiological ligands of human STING (see, e.g., Civril et al. (2013) *Nature* 498 (7454):332-337; Diner et al. (2013) *Cell Rep.* 3(5):1355-1361; Gao et al. (2013) *Sci. Signal* 6(269):pl1; Ablasser et al. (2013) *Nature* 503(7477):530-534).

The cGAS/STING signaling pathway in humans has evolved to preferentially respond to viral pathogens over bacterial pathogens, and this can explain why previous bacterial vaccines harboring host tumor antigens have made for poor $CD8^+$ T cell priming vectors in humans. TLR-independent activation of $CD8^+$ T cells by STING-dependent type I IFN signaling from conventional DCs is the primary mechanism by which viruses are detected, with TLR-dependent type I IFN production by plasmacytoid DCs operating only when the STING pathway has been virally-inactivated (Hervas-Stubbs et al. (2014) *J. Immunol.* 193: 1151-1161). Further, for bacteria such as *S. typhimurium*, while capable of inducing IFN-β via TLR4, $CD8^+$ T cells are neither induced nor required for clearance or protective immunity (Lee et al. (2012) *Immunol Lett.* 148(2): 138-143). The lack of physiologically relevant $CD8^+$ T epitopes for many strains of bacteria, including *S. typhimurium*, has impeded bacterial vaccine development and protective immunity to subsequent infections, even from the same genetic strains (Lo et al. (1999) *J. Immunol.* 162:5398-5406). Bacterially-based cancer immunotherapies are biologically limited in their ability to induce type I IFN to recruit and activate $CD8^+$ T cells, which is necessary to promote tumor antigen cross-presentation and durable anti-tumor immunity. The immunostimulatory bacteria provided herein, however, are engineered to solve this problem. The immunostimulatory bacteria provided herein induce viral-like TLR-independent type I IFN signaling, rather than TLR-dependent bacterial immune signaling, which preferentially induces $CD8^+$ T cell mediated anti-tumor immunity.

STING activates innate immunity in response to sensing nucleic acids in the cytosol. Downstream signaling is activated through binding of CDNs, which are synthesized by bacteria or by the host enzyme cGAS in response to binding to cytosolic dsDNA. Bacterial and host-produced CDNs have distinct phosphate bridge structures, which differentiates their capacity to activate STING. IFN-β is the signature cytokine of activated STING, and virally-induced type I IFN, rather than bacterially-induced IFN, is required for effective $CD8^+$ T cell mediated anti-tumor immunity. Immunostimulatory bacteria provided herein include those that are STING agonists and those that express STING.

3. *Salmonella* Therapy

*Salmonella* is exemplary of a bacterial genus that can be used as a cancer therapeutic. The *Salmonella* exemplified herein is an attenuated species or is one that, by virtue of the modifications described herein, for use as a cancer therapeutic, has reduced toxicity.

a. Tumor-Tropic Bacteria

A number of bacterial species have demonstrated preferential replication within solid tumors when injected from a distal site. These include, but are not limited to, species of *Salmonella, Bifodobacterium, Clostridium*, and *Escherichia*. The natural tumor-homing properties of the bacteria combined with the host's innate immune response to the bacterial infection is thought to mediate the anti-tumor response. This tumor tissue tropism has been shown to reduce the size of tumors to varying degrees. One contributing factor to the tumor tropism of these bacterial species is the ability to replicate in anoxic or hypoxic environments. A number of these naturally tumor-tropic bacteria have been further engineered to increase the potency of the antitumor response (reviewed in Zu et al. (2014) *Crit Rev Microbiol.* 40(3):225-235; and Felgner et al. (2017) *Microbial Biotechnology* 10(5):1074-1078).

b. *Salmonella enterica* serovar *Typhimurium*

*Salmonella enterica* serovar *Typhimurium* (*S. typhimurium*) is exemplary of a bacterial species for use as an anti-cancer therapeutic. One approach to using bacteria to stimulate host immunity to cancer has been through the Gram-negative facultative anaerobe *S. typhimurium*, which preferentially accumulates in hypoxic and necrotic areas in the body, including tumor microenvironments. *S. typhimurium* accumulates in these environments due to the availability of nutrients from tissue necrosis, the leaky tumor vasculature, and their increased likelihood to survive in the immune system-evading tumor microenvironment (Baban et al. (2010) *Bioengineered Bugs* 1(6):385-394). *S. typhimurium* is able to grow under both aerobic and anaerobic conditions; therefore, it is able to colonize small tumors that are less hypoxic, and large tumors that are more hypoxic.

*S. typhimurium* is a Gram-negative, facultative pathogen that is transmitted via the fecal-oral route. It causes localized gastrointestinal infections, but also enters the bloodstream and lymphatic system after oral ingestion, infecting systemic tissues such as the liver, spleen and lungs. Systemic administration of wild-type *S. typhimurium* overstimulates TNF-α induction, leading to a cytokine cascade and septic shock, which, if left untreated, can be fatal. As a result, pathogenic bacterial strains, such as *S. typhimurium*, must be attenuated to prevent systemic infection, without completely suppressing their ability to effectively colonize tumor tissues. Attenuation is often achieved by mutating a cellular structure that can elicit an immune response, such as the bacterial outer membrane, or limiting its ability to replicate in the absence of supplemental nutrients.

*S. typhimurium* is an intracellular pathogen that is rapidly taken up by myeloid cells, such as macrophages, or it can induce its own uptake in non-phagocytic cells, such as epithelial cells. Once inside cells, it can replicate within a *Salmonella* containing vacuole (SCV) and can also escape into the cytosol of some epithelial cells. Many of the molecular determinants of *S. typhimurium* pathogenicity have been identified and the genes are clustered in *Salmonella* pathogenicity islands (SPIs). The two best characterized pathogenicity islands are SPI-1, which is responsible for mediating bacterial invasion of non-phagocytic cells, and SPI-2 which is required for replication within the SCV (Agbor and McCormick (2011) *Cell Microbiol.* 13(12): 1858-1869). Both of these pathogenicity islands encode macromolecular structures called type three secretion systems (T3SS) that can translocate effector proteins across the host membrane (Galan and Wolf-Watz (2006) *Nature* 444: 567-573).

c. Bacterial Attenuation

Therapeutic bacteria for administration as a cancer treatment should be modified so that they do not cause diseases. Various methods to achieve this are known in the art. Auxotrophic mutations, for example, render bacteria incapable of synthesizing an essential nutrient, and deletions/mutations in genes such as aro, pur, gua, thy, nad and asd (U.S. Patent Publication No. 2012/0009153) are widely used. Nutrients produced by the biosynthesis pathways involving these genes are often unavailable in host cells, and as such, bacterial survival is challenging. For example, attenuation of *Salmonella* and other species can be achieved by deletion of the aroA gene, which is part of the shikimate pathway, connecting glycolysis to aromatic amino acid biosynthesis (Feigner et al. (2016) *MBio* 7(5):e01220-16). Deletion of aroA therefore results in bacterial auxotrophy for aromatic amino acids and subsequent attenuation (U.S. Patent Publication Nos. 2003/0170276, 2003/0175297, 2012/0009153 and 2016/0369282; International Application Publication Nos. WO 2015/032165 and WO 2016/025582). Similarly, other enzymes involved in the biosynthesis pathway for aromatic amino acids, including aroC and aroD have been deleted to achieve attenuation (U.S. Patent Publication No. 2016/0369282; International Application Publication No. WO 2016/025582). For example, *S. typhimurium* strain SL7207 is an aromatic amino acid auxotroph ($aroA^-$ mutant); strains A1 and A1-R are leucine-arginine auxotrophs. VNP20009 is a purine auxotroph ($purI^-$ mutant). As shown herein, it is also auxotrophic for the immunosuppressive nucleoside adenosine.

Mutations that attenuate bacteria also include, but are not limited to, mutations in genes that alter the biosynthesis of lipopolysaccharide, such as rfaL, rfaG, rfaH, rfaD, rfaP, rFb, rfa, msbB, htrB, firA, pagL, pagP, lpxR, arnT, eptA, and lpxT; mutations that introduce a suicide gene, such as sacB, nuk, hok, gef, kil or phlA; mutations that introduce a bacterial lysis gene, such as hly and cly; mutations in virulence factors, such as isyA, pag, prg, iscA, virG, plc and act; mutations that modify the stress response, such as recA, htrA, htpR, hsp and groEL; mutations that disrupt the cell cycle, such as min; and mutations that disrupt or inactivate regulatory functions, such as cya, crp, phoP/phoQ, and ompR (U.S. Patent Publication Nos. 2012/0009153, 2003/0170276, 2007/0298012; U.S. Pat. No. 6,190,657; International Application Publication No. WO 2015/032165; Feigner et al. (2016) *Gut microbes* 7(2):171-177; Broadway et al. (2014) *J. Biotechnology* 192:177-178; Frahm et al. (2015) *mBio* 6(2):e00254-15; Kong et al. (2011) *Infection and Immunity* 79(12):5027-5038; Kong et al. (2012) *Proc. Natl. Acad. Sci. USA* 109(47):19414-19419). Ideally, the genetic attenuations comprise gene deletions rather than point mutations to prevent spontaneous compensatory mutations that might result in reversion to a virulent phenotype.

i. $msbB^-$ Mutants

The enzyme lipid A biosynthesis myristoyltransferase, encoded by the msbB gene in *S. typhimurium*, catalyzes the addition of a terminal myristyl group to the lipid A domain of lipopolysaccharide (LPS) (Low et al. (1999) *Nat. Biotechnol.* 17(1):37-41). Deletion of msbB thus alters the acyl composition of the lipid A domain of LPS, the major component of the outer membranes of Gram-negative bacteria. This modification significantly reduces the ability of the LPS to induce septic shock, attenuating the bacterial strain and reducing the potentially harmful production of TNFα, thus, lowering systemic toxicity. *S. typhimurium* msbB mutants maintain their ability to preferentially colonize tumors over other tissues in mice and retain anti-tumor activity, thus, increasing the therapeutic index of *Salmonella*-based immunotherapeutics (see, e.g., U.S. Patent Publication Nos. 2003/0170276, 2003/0109026, 2004/0229338, 2005/0255088 and 2007/0298012).

For example, deletion of msbB in the *S. typhimurium* strain VNP20009 results in production of a predominantly penta-acylated LPS, which is less toxic than native hexa-acylated LPS, and allows for systemic delivery without the induction of toxic shock (Lee et al. (2000) *International Journal of Toxicology* 19:19-25). Other LPS mutations can be introduced into the bacterial strains provided herein, including the *Salmonella* strains, that dramatically reduce virulence, and thereby provide for lower toxicity, and permit administration of higher doses.

ii. purI$^-$ Mutants

Immunostimulatory bacteria that can be attenuated by rendering them auxotrophic for one or more essential nutrients, such as purines (for example, adenine), nucleosides (for example, adenosine) or amino acids (for example, arginine and leucine), are employed. In particular, in embodiments of the immunostimulatory bacteria provided herein, such as *S. typhimurium*, the bacteria are rendered auxotrophic for adenosine, which preferentially accumulates in tumor microenvironments. Hence, strains of immunostimulatory bacteria described herein are attenuated because they require adenosine for growth, and they preferentially colonize TMEs, which, as discussed below, have an abundance of adenosine.

Phosphoribosylaminoimidazole synthetase, an enzyme encoded by the purI gene (synonymous with the purM gene), is involved in the biosynthesis pathway of purines. Disruption of the purI gene thus renders the bacteria auxotrophic for purines. In addition to being attenuated, purI$^-$ mutants are enriched in the tumor environment and have significant anti-tumor activity (Pawelek et al. (1997) *Cancer Research* 57:4537-4544). It was previously described that this colonization results from the high concentration of purines present in the interstitial fluid of tumors as a result of their rapid cellular turnover. Since the purI$^-$ bacteria are unable to synthesize purines, they require an external source of adenine, and it was thought that this would lead to their restricted growth in the purine-enriched tumor microenvironment (Rosenberg et al. (2002) *J. Immunotherapy* 25(3):218-225). While the VNP20009 strain was initially reported to contain a deletion of the purI gene (Low et al. (2003) *Methods in Molecular Medicine* Vol. 90, *Suicide Gene Therapy:*47-59), subsequent analysis of the entire genome of VNP20009 demonstrated that the purI gene is not deleted, but is disrupted by a chromosomal inversion (Broadway et al. (2014) *Journal of Biotechnology* 192:177-178). The entire gene is contained within two parts of the VNP20009 chromosome that is flanked by insertion sequences (one of which has an active transposase).

It is shown herein, that, purI mutant *S. typhimurium* strains are auxotrophic for the nucleoside adenosine, which is highly enriched in tumor microenvironments. Hence, when using VNP20009, it is not necessary to introduce any further modification to achieve adenosine auxotrophy. For other strains and bacteria, the purI gene can be disrupted as it has been in VNP20009, or it can contain a deletion of all or a portion of the purI gene to prevent reversion to a wild-type gene.

iii. Combinations of Attenuating Mutations

A bacterium with multiple genetic attenuations by means of gene deletions on disparate regions of the chromosome is desirable for bacterial immunotherapies because the attenuation can be increased, while decreasing the possibility of reversion to a virulent phenotype by acquisition of genes by homologous recombination with a wild-type genetic material. Restoration of virulence by homologous recombination would require two separate recombination events to occur within the same organism. Ideally, the combination of attenuating mutations selected for use in an immunotherapeutic agent increases the tolerability without decreasing the potency, thereby increasing the therapeutic index.

For example, as discussed below, disruption of the msbB and purI genes in *S. typhimurium* strain VNP20009, has been used for tumor-targeting and growth suppression, and elicits low toxicity in animal models (Clairmont et al. (2000) *J. Infect. Dis.* 181:1996-2002; Bermudes et al. (2000) *Cancer Gene Therapy: Past Achievements and Future Challenges*, edited by Habib Kluwer Academic/Plenum Publishers, New York, pp. 57-63; Low et al. (2003) *Methods in Molecular Medicine*, Vol. 90, *Suicide Gene Therapy:*47-59; Lee et al. (2000) *International Journal of Toxicology* 19:19-25; Rosenberg et al. (2002) *J. Immunotherapy* 25(3):218-225; Broadway et al. (2014) *J. Biotechnology* 192:177-178; Loeffler et al. (2007) *Proc. Natl. Acad. Sci. U.S.A.* 104(31):12879-12883; Luo et al. (2002) *Oncology Research* 12:501-508). VNP20009, however, does not show the same tumor accumulation and anti-tumor activity in human trials. Higher doses, which are required to manifest any anti-tumor activity, thus, are not possible due to toxicity. The immunostimulatory bacteria provided herein, which contain combinations of genetic modifications that, for example, reduce virulence, increase tolerability, decrease or eliminate bacterial infection of epithelial (and other non-immune) cells, increase accumulation in tumor-resident immune cells, and reduce cell death of tumor-resident immune cells, among other desirable properties that improve the therapeutic index, address this problem.

iv. VNP20009 and Other Attenuated *S. typhimurium* Strains

Exemplary of a therapeutic bacterium that can be modified as described herein is the strain designated as VNP20009 (YS1646). The clinical candidate, VNP20009 (YS1646), was at least 50,000-fold attenuated for safety by deletion of both the msbB and purI genes (Clairmont et al. (2000) *J. Infect. Dis.* 181:1996-2002; Low et al. (2003) *Methods in Molecular Medicine*, Vol. 90, *Suicide Gene Therapy:* 47-59; Lee et al. (2000) *International Journal of Toxicology* 19:19-25). Similar strains of *Salmonella* that are attenuated also are contemplated. As described above, deletion of msbB alters the composition of the lipid A domain of lipopolysaccharide, the major component of Gram-negative bacterial outer membranes (Low et al. (1999) *Nat. Biotechnol.* 17 (1): 37-41). This prevents lipopolysaccharide-induced septic shock, attenuating the bacterial strain and lowering systemic toxicity, while reducing the potentially harmful production of TNFα (Dinarello, C. A. (1997) *Chest* 112 (6 Suppl): 321S-329S; Low et al. (1999) *Nat. Biotechnol.* 17 (1): 37-41). Deletion of the purI gene renders the bacteria auxotrophic for purines, which further attenuates the bacteria and enriches it in the tumor microenvironment (Pawelek et al. (1997) *Cancer Res.* 57:4537-4544; Broadway et al. (2014) *J. Biotechnology* 192:177-178).

The accumulation of VNP20009 in tumors results from a combination of factors including: the inherent invasiveness of the parental strain (the strain deposited under ATCC accession no. 14028), its ability to replicate in hypoxic environments, and its requirement for high concentrations of purines that are present in the interstitial fluid of tumors. It also is shown herein that VNP20009 also is auxotrophic for the nucleoside adenosine, which can accumulate to pathologically high levels in the tumor microenvironment and contribute to an immunosuppressive tumor microenvironment (Peter Vaupel and Arnulf Mayer Oxygen Transport to Tissue XXXVII, Advances in Experimental Medicine and Biology 876 chapter 22, pp. 177-183). When VNP20009 was administered into mice bearing syngeneic or human xenograft tumors, the bacteria accumulated preferentially within the extracellular components of tumors at ratios exceeding 300-1000 to 1, reduced TNFα induction, and demonstrated tumor growth inhibition as well as prolonged survival compared to control mice (Clairmont et al. (2000) *J. Infect. Dis.* 181:1996-2002). Results from the Phase 1 clinical trial in humans, however, revealed that while VNP20009 was relatively safe and well tolerated, poor accumulation was observed in human melanoma tumors, and very little anti-tumor activity was demonstrated (Toso et al. (2002) *J. Clin. Oncol.* 20 (1): 142-152). Higher doses, which would be required to affect any anti-tumor activity, were not possible due to toxicity that correlated with high levels of pro-inflammatory cytokines.

Other strains of *S. typhimurium* can be used for tumor-targeted delivery and therapy, such as, for example, leucine-arginine auxotroph A-1 (Zhao et al. (2005) *Proc. Natl. Acad. Sci. USA* 102(3):755-760; Yu et al. (2012) *Scientific Reports* 2:436; U.S. Pat. No. 8,822,194; U.S. Patent Publication No. 2014/0178341) and its derivative AR-1 (Yu et al. (2012) *Scientific Reports* 2:436; Kawaguchi et al. (2017) *Oncotarget* 8(12): 19065-19073; Zhao et al. (2006) *Cancer Res.* 66(15):7647-7652; Zhao et al. (2012) *Cell Cycle* 11(1): 187-193; Tome et al. (2013) *Anticancer Research* 33:97-102; Murakami et al. (2017) *Oncotarget* 8(5):8035-8042; Liu et al. (2016) *Oncotarget* 7(16):22873-22882; Binder et al. (2013) *Cancer Immunol Res.* 1(2):123-133); aroA$^-$ mutant *S. typhimurium* strain SL7207 (Guo et al. (2011) *Gene therapy* 18:95-105; U.S. Patent Publication Nos. 2012/0009153, 2016/0369282 and 2016/0184456) and its obligate anaerobe derivative YB1 (International Application Publication No. WO 2015/032165; Yu et al. (2012) *Scientific Reports* 2:436; Leschner et al. (2009) *PLoS ONE* 4(8): e6692); aroA$^-$/aroD$^-$ mutant *S. typhimurium* strain BRD509, a derivative of the SL1344 (wild-type) strain (Yoon et al. (2017) *European J. of Cancer* 70:48-61); asd$^-$/cya$^-$/crp$^-$ mutant *S. typhimurium* strain χ4550 (Sorenson et al. (2010) *Biologics: Targets & Therapy* 4:61-73) and phoP$^-$/phoQ$^-$ *S. typhimurium* strain LH430 (International Application Publication No. WO 2008/091375).

The strain VNP20009 failed to show a clinical benefit in a study involving patients with advanced melanoma, but the treatment was safely administered to advanced cancer patients. A maximum tolerated dose (MTD) was established. Hence, this strain, as well as other similarly engineered bacterial strains, can be used as a starting material for tumor-targeting, therapeutic delivery vehicles. Modifications provided herein provide a strategy to increase efficacy, by increasing the anti-tumor efficiency and/or the safety and tolerability of the therapeutic agent.

v. *S. typhimurium* Engineered to Deliver Macromolecules

*S. typhimurium* also has been modified to deliver the tumor-associated antigen (TAA) survivin (SVN) to APCs to prime adaptive immunity (U.S. Patent Publication No. 2014/0186401; Xu et al. (2014) *Cancer Res.* 74(21):6260-6270). SVN is an inhibitor of apoptosis protein (IAP) which prolongs cell survival and provides cell cycle control, and is overexpressed in all solid tumors and poorly expressed in normal tissues. This technology employs the *Salmonella* Pathogenicity Island 2 (SPI-2) and its type III secretion system (T3 SS) to deliver the TAAs into the cytosol of APCs, which then are activated to induce TAA-specific CD8$^+$ T cells and anti-tumor immunity (Xu et al. (2014) *Cancer Res.* 74(21):6260-6270). Similar to the *Listeria*-based TAA vaccines, this approach has shown promise in mouse models, but has yet to demonstrate effective tumor antigen-specific T cell priming in humans.

In addition to gene delivery, *S. typhimurium* also has been used for the delivery of small interfering RNAs (siRNAs) and short hairpin RNAs (shRNAs) for cancer therapy. For example, attenuated *S. typhimurium* have been modified to express certain shRNAs, such as those that target STAT3 and IDO1 (International Application Publication No. WO 2008/091375; and U.S. Pat. No. 9,453,227). VNP20009 transformed with an shRNA plasmid against the immunosuppressive gene indolamine deoxygenase (IDO), successfully silenced IDO expression in a murine melanoma model, resulting in tumor cell death and significant tumor infiltration by neutrophils (Blache et al. (2012) *Cancer Res.* 72(24): 6447-6456). Combining this vector with the co-administration of PEGPH20 (an enzyme that depletes extracellular hyaluronan), showed positive results in the treatment of pancreatic ductal adenocarcinoma tumors (Manuel et al. (2015) *Cancer Immunol. Res.* 3(9):1096-1107; U.S. Patent Publication No. 2016/0184456). In another study, an *S. typhimurium* strain attenuated by a phoP/phoQ deletion and expressing a signal transducer and activator of transcription 3 (STAT3)-specific shRNA, was found to inhibit tumor growth and reduce the number of metastatic organs, extending the life of C57BL6 mice (Zhang et al. (2007) *Cancer Res.* 67(12):5859-5864). In another example, *S. typhimurium* strain SL7207 has been used for the delivery of shRNA targeting CTNNB1, the gene that encodes β-catenin (Guo et al. (2011) *Gene therapy* 18:95-105; U.S. Patent Publication Nos. 2009/0123426, 2016/0369282), while *S. typhimurium* strain VNP20009 has been utilized in the delivery of shRNA targeting STAT3 (Manuel et al. (2011) *Cancer Res.* 71(12): 4183-4191; U.S. Patent Publication Nos. 2009/0208534, 2014/0186401 and 2016/0184456; International Application Publication Nos. WO 2008/091375 and WO 2012/149364). siRNAs targeting the autophagy genes Atg5 and Beclin1 have been delivered to tumor cells using *S. typhimurium* strains A1-R and VNP20009 (Liu et al. (2016) *Oncotarget* 7(16):22873-22882). Improvement of such strains is needed so that they more effectively stimulate the immune response, and have other advantageous properties, such as the immunostimulatory bacteria provided herein. Further and alternative modifications of various bacteria have been described in published International PCT Application Publication No. WO 2019/014398 and U.S. Publication No. 2019/0017050 A1. The bacteria described in each of these publications, also described herein, can be modified as described herein to further improve the immunostimulatory and tumor-targeting properties.

The bacteria can be modified as described herein to have reduced inflammatory effects, and thus, to be less toxic. As a result, for example, higher dosages can be administered. Any of these strains of *Salmonella*, as well as other species of bacteria, known to those of skill in the art and/or listed above and herein, can be modified as described herein, such as by introducing adenosine auxotrophy. Exemplary are the *S. typhimurium* species described herein.

The bacterial strains provided herein are engineered to deliver therapeutic molecules/products. The strains herein deliver immunostimulatory proteins, including modified gain-of-function variants of cytosolic DNA/RNA sensors that can constitutively evoke/induce type I IFN expression, and other immunostimulatory proteins, such as cytokines, that promote an anti-tumor immune response in the tumor microenvironment. The strains also can include genomic modifications that reduce pyroptosis of phagocytic cells, thereby providing for a more robust immune response, and/or reduce or eliminate the ability to infect/invade epithelial cells, but retain the ability to infect/invade phagocytic cells, so that they accumulate more effectively in tumors and in tumor-resident immune cells. The bacterial strains encode therapeutic products. Accumulation in tumor-resident immune cells allows the encoded therapeutic products to be expressed and secreted into the tumor microenvironment, increasing the therapeutic efficacy.

4. Enhancements of Immunostimulatory Bacteria to Increase Therapeutic Index and Expression in Tumor-Resident Immune Cells Provided herein are enhancements to immunostimulatory bacteria that reduce toxicity and improve the anti-tumor activity. Exemplary of such enhancements are the following. They are described with respect to *Salmonella*, particularly *S. typhimurium*; it is understood that the skilled person can effect similar enhancements in other bacterial species and other *Salmonella* strains.

a. asd Gene Deletion

The asd gene in bacteria encodes an aspartate-semialdehyde dehydrogenase. asd$^-$ mutants of *S. typhimurium* have an obligate requirement for diaminopimelic acid (DAP) which is required for cell wall synthesis and will undergo lysis in environments deprived of DAP. This DAP auxotrophy can be used for plasmid selection and maintenance of plasmid stability in vivo, without the use of antibiotics, when the asd gene is complemented in trans on a plasmid. Non-antibiotic-based plasmid selection systems are advantageous and allow for: 1) the use of administered antibiotics as a rapid clearance mechanism in the event of adverse symptoms, and 2) antibiotic-free scale up of production, where such use is commonly avoided. The asd gene complementation system provides for such selection (Galan et al. (1990) *Gene* 94(1):29-35). The use of the asd gene complementation system to maintain plasmids in the tumor microenvironment is expected to increase the potency of *S. typhimurium* engineered to deliver plasmids encoding genes, and therapeutic products/proteins, such as the STING proteins, and other immunostimulatory proteins, as described herein.

An alternative use for an asd mutant of *S. typhimurium* is to exploit the DAP auxotrophy to produce an autolytic (or suicidal) strain for delivery of macromolecules to infected cells without the ability to persistently colonize host tumors. Deletion of the asd gene makes the bacteria auxotrophic for DAP when grown in vitro or in vivo. An example described herein (see, e.g., Example 3), provides an asd deletion strain that is auxotrophic for DAP and contains a plasmid that encodes a therapeutic product, and that does not contain an asd complementing gene, resulting in a strain that is defective for replication in vivo. This strain is propagated in vitro in the presence of DAP and grows normally, and then is administered as an immunotherapeutic agent to a mammalian host, where DAP is not present. The suicidal strain is able to invade host cells but is not be able to replicate due to the absence of DAP in mammalian tissues, lysing automatically and delivering its cytosolic contents (e.g., plasmids or proteins).

In examples provided herein, an asd gene deleted strain of VNP20009 was further modified to express an LLO protein lacking its endogenous periplasmic secretion signal sequence (cytoLLO), causing it to accumulate in the cytoplasm of the *Salmonella*. LLO is a cholesterol-dependent pore forming hemolysin from *Listeria monocytogenes* that mediates phagosomal escape of bacteria. When the autolytic strain is introduced into tumor bearing mice, the bacteria are taken up by phagocytic immune cells and enter the *Salmonella* containing vacuole (SCV). In this environment, the lack of DAP will prevent bacterial replication, and result in autolysis of the bacteria in the SCV. Lysis of the suicidal strain will then allow for release of the plasmid and the accumulated LLO that will form pores in the cholesterol-containing SVC membrane, and allow for delivery of the plasmid into the cytosol of the host cell. Here, gene products encoded on the plasmid, that are under control of a eukaryotic promoter, can be expressed by the host cell machinery.

b. Adenosine Auxotrophy

Metabolites derived from the tryptophan and ATP/adenosine pathways are major drivers in forming an immunosuppressive environment within the tumor. Adenosine, which exists in the free form inside and outside of cells, is an effector of immune function. Adenosine decreases T-cell receptor induced activation of NF-κB, and inhibits IL-2, IL-4, and IFN-γ. Adenosine decreases T-cell cytotoxicity, increases T-cell anergy, and increases T-cell differentiation to Foxp3$^+$ or Lag-3$^+$ regulatory T-cells (T-regs). In NK cells, adenosine decreases IFN-γ production, and suppresses NK cell cytotoxicity. Adenosine blocks neutrophil adhesion and extravasation, decreases phagocytosis, and attenuates levels of superoxide and nitric oxide. Adenosine also decreases the expression of TNF-α, IL-12, and MIP-1α (CCL3) on macrophages, attenuates MHC Class II expression, and increases levels of IL-10 and IL-6. Adenosine immunomodulation activity occurs after its release into the extracellular space of the tumor and activation of adenosine receptors (ADRs) on the surfaces of target immune cells, cancer cells or endothelial cells. The high adenosine levels in the tumor microenvironment result in local immunosuppression, which limits the capacity of the immune system to eliminate cancer cells.

Extracellular adenosine is produced by the sequential activities of membrane associated ectoenzymes, CD39 and CD73, which are expressed on tumor stromal cells, together producing adenosine by phosphohydrolysis of ATP or ADP produced from dead or dying cells. CD39 converts extracellular ATP (or ADP) to 5'AMP, which is converted to adenosine by CD73. Expression of CD39 and CD73 on endothelial cells is increased under the hypoxic conditions of the tumor microenvironment, thereby increasing levels of adenosine. Tumor hypoxia can result from inadequate blood supply and disorganized tumor vasculature, impairing delivery of oxygen (Carroll and Ashcroft (2005) *Expert. Rev. Mol. Med.* 7(6):1-16). Hypoxia, which occurs in the tumor microenvironment, also inhibits adenylate kinase (AK), which converts adenosine to AMP, leading to very high extracellular adenosine concentrations. The extracellular concentration of adenosine in the hypoxic tumor microenvironment has been measured at 10-100 μM, which is up to about 100-1000 fold higher than the typical extracellular adenosine concentration of approximately 0.1 μM (Vaupel et al. (2016) *Adv. Exp. Med. Biol.* 876:177-183; Antonioli et al. (2013) *Nat. Rev. Can.* 13:842-857). Since hypoxic regions in tumors are distal from microvessels, the local concentration of adenosine in some regions of the tumor can be higher than others.

To direct effects to inhibit the immune system, adenosine also can control cancer cell growth and dissemination by effects on cancer cell proliferation, apoptosis and angiogenesis. For example, adenosine can promote angiogenesis, primarily through the stimulation of $A_{2A}$ and $A_{2B}$ receptors. Stimulation of the receptors on endothelial cells can regulate the expression of intercellular adhesion molecule 1 (ICAM-1) and E-selectin on endothelial cells, maintain vascular integrity, and promote vessel growth (Antonioli et al. (2013) *Nat. Rev. Can.* 13:842-857). Activation of one or more of $A_{2A}$, $A_{2B}$ or $A_3$ on various cells by adenosine can stimulate the production of the pro-angiogenic factors, such as vascular endothelial growth factor (VEGF), interleukin-8 (IL-8), or angiopoietin 2 (Antonioli et al. (2013) *Nat. Rev. Can.* 13:842-857).

Adenosine also can directly regulate tumor cell proliferation, apoptosis and metastasis through interaction with receptors on cancer cells. For example, studies have shown that the activation of $A_1$ and $A_{2A}$ receptors promote tumor cell proliferation in some breast cancer cell lines, and activation of $A_{2B}$ receptors have cancer growth-promoting properties in colon carcinoma cells (Antonioli et al. (2013) *Nat. Rev. Can.* 13:842-857). Adenosine also can trigger apoptosis of cancer cells, and various studies have correlated this activity to activation of the extrinsic apoptotic pathway through $A_3$ or the intrinsic apoptotic pathway through $A_{2A}$ and $A_{2B}$ (Antonioli et al. (2013)). Adenosine can promote tumor cell migration and metastasis, by increasing cell motility, adhesion to the extracellular matrix, and expression of cell attachment proteins and receptors to promote cell movement and motility.

The extracellular release of adenosine triphosphate (ATP) occurs from stimulated immune cells and damaged, dying or stressed cells. The NLR family pyrin domain-containing 3 (NLRP3) inflammasome, when stimulated by this extracellular release of ATP, activates caspase-1 and results in the secretion of the cytokines IL-1β and IL-18, which in turn activate innate and adaptive immune responses (Stagg and Smyth (2010) *Oncogene* 29:5346-5358). ATP is catabolized into adenosine by the enzymes CD39 and CD73. Activated adenosine acts as a highly immunosuppressive metabolite via a negative-feedback mechanism and has a pleiotropic effect against multiple immune cell types in the hypoxic tumor microenvironment (Stagg and Smyth (2010) *Oncogene* 29:5346-5358). Adenosine receptors $A_{2A}$ and $A_{2B}$ are expressed on a variety of immune cells and are stimulated by adenosine to promote cAMP-mediated signaling changes, resulting in immunosuppressive phenotypes of T-cells, B-cells, NK cells, dendritic cells, mast cells, macrophages, neutrophils, and NKT cells. As a result of this, adenosine levels can accumulate to over one hundred times their normal concentration in pathological tissues, such as solid tumors, which have been shown to overexpress ecto-nucleotidases, such as CD73. Adenosine has also been shown to promote tumor angiogenesis and development. An engineered bacterium that is auxotrophic for adenosine would thus exhibit enhanced tumor-targeting and colonization.

Immunostimulatory bacteria, such as *Salmonella typhi*, can be made auxotrophic for adenosine by deletion of the tsx gene (Bucarey et al. (2005) *Infection and Immunity* 73(10): 6210-6219) or by deletion of purD (Husseiny (2005) *Infection and Immunity* 73(3):1598-1605). In the Gram negative bacteria *Xanthomonas oryzae*, a purD gene knockout strain was shown to be auxotrophic for adenosine (Park et al. (2007) *FEMS Microbiol. Lett.* 276:55-59). As exemplified herein, *S. typhimurium* strain VNP20009, is auxotrophic for adenosine due to its purI deletion, hence, further modification to render it auxotrophic for adenosine is not required. Hence, embodiments of the immunostimulatory bacterial strains, as provided herein, are auxotrophic for adenosine. Such auxotrophic bacteria selectively replicate in the tumor microenvironment, further increasing accumulation and replication of the administered bacteria in tumors, and decreasing the levels of adenosine in and around tumors, thereby reducing or eliminating the immunosuppression caused by accumulation of adenosine. Exemplary of such bacteria, provided herein, is a modified strain of *S. typhimurium* containing $purI^-/msbB^-$ mutations to provide adenosine auxotrophy. Other genomic mutations also can be included to impart other advantageous properties to the bacteria, as discussed herein.

c. Flagellin Deficient Strains

Flagella are organelles on the surface of bacteria that are composed of a long filament attached via a hook to a rotary motor that can rotate in a clockwise or counterclockwise manner to provide a means for locomotion. Flagella in *S. typhimurium* are important for chemotaxis and for establishing an infection via the oral route, due to the ability to mediate motility across the mucous layer in the gastrointestinal tract. While flagella have been demonstrated to be required for chemotaxis to and colonization of tumor cylindroids in vitro (Kasinskas and Forbes (2007) *Cancer Res.* 67(7):3201-3209), and motility has been shown to be important for tumor penetration (Toley and Forbes (2012) *Integr. Biol.* (*Camb*). 4(2):165-176), flagella are not required for tumor colonization in animals when the bacteria are administered intravenously (Stritzker et al. (2010) *International Journal of Medical Microbiology* 300:449-456). Each flagellar filament is composed of tens of thousands of flagellin subunits. The *S. typhimurium* chromosome contains two genes, fliC and fljB, that encode antigenically distinct flagellin monomers. Mutants defective for both fliC and fljB are nonmotile and avirulent when administered via the oral route of infection, but maintain virulence when administered parenterally.

Flagellin is a major pro-inflammatory determinant of *Salmonella* (Zeng et al. (2003) *J. Immunol.* 171:3668-3674), and is directly recognized by TLR5 on the surface of cells, and by NLRC4 in the cytosol (Lightfield et al. (2008) *Nat Immunol.* 9(10):1171-1178). Both pathways lead to pro-inflammatory responses resulting in the secretion of cytokines, including IL-1β, IL-18, TNF-α and IL-6. Attempts have been made to make *Salmonella*-based cancer immunotherapy more potent by increasing the pro-inflammatory response to flagellin by engineering the bacteria to secrete *Vibrio vulnificus* flagellin B, which induces greater inflammation than flagellin encoded by fliC and fljB (Zheng et al. (2017) *Sci. Transl. Med.* 9(376):eaak9537).

Provided are immunostimulatory bacteria, such as the *Salmonella* species *S. typhimurium*, engineered to lack both flagellin subunits fliC and fljB, to reduce pro-inflammatory signaling. For example, as shown herein, a *Salmonella* strain lacking msbB, which results in reduced TNF-alpha induction, is combined with fliC and fljB knockouts. The resulting *Salmonella* strain has a combined reduction in TNF-alpha induction and reduction in TLR5 recognition. These modifications, $msbB^-$, $fliC^-$ and $fljB^-$, can be combined with a bacterial plasmid, optionally containing CpGs, and also a cDNA expression cassette to provide expression of a heterologous protein(s) under the control of a eukaryotic promoter, such as, for example, STING pathway gain-of-function protein variants, immunostimulatory cytokines, and/or also inhibitory RNAi molecule(s). The resulting bacteria have reduced proinflammatory signaling, and robust anti-tumor activity.

Elimination of the flagella imparts additional advantageous properties that increase the therapeutic index of the bacteria. For example, as shown herein (see, e.g., Example 6), elimination of the flagella (i.e., in *Salmonella*, fliC$^-$/fljB$^-$), decreases pyroptosis in murine macrophages and in human monocytes, results in an inability to infect epithelial cells, and restricts uptake of the bacteria to tumor-resident immune/myeloid cells.

As described below and elsewhere herein, deletion of the flagella can be combined with one or more other genomic modifications that impart advantageous properties that improve the therapeutic index of the bacteria, including, for example, asd$^-$, msbB$^-$, purI$^-$, pagP$^-$, csgD$^-$, adrA$^-$, and/or other modifications as described herein. Such modified bacteria can be transformed with a plasmid encoding therapeutic products that increase the anti-tumor immune response in the subject, including, for example, cytosolic DNA/RNA sensors and gain-of-function mutants thereof, as well as immunostimulatory proteins, such as cytokines.

For example, as provided herein, a fliC$^-$ and fljB$^-$ double mutant was constructed in the asd deleted strain of *S. typhimurium* strain VNP20009. VNP20009, which is attenuated for virulence by disruption of purI/purM, also was engineered to contain an msbB deletion, that results in production of a lipid A subunit of LPS that is less toxigenic than wild-type lipid A. This results in reduced TNF-α production in a mouse model after intravenous administration, compared to strains with wild-type lipid A. Also, a fliC$^-$ and fljB$^-$ double mutant was constructed on a wild-type strain of *S. typhimurium* containing the asd, purI/purM and msbB deletions. The resulting strains are exemplary of strains that are attenuated for bacterial inflammation by modification of lipid A to reduce TLR2/4 signaling, and deletion of the flagellin subunits to reduce TLR5 recognition and inflammasome induction. Deletion of the flagellin subunits combined with modification of the LPS allows for greater tolerability in the host, and directs the immunostimulatory response towards production of immunostimulatory proteins and/or delivery of RNA interference against desired targets in the TME, which elicits an anti-tumor response and promotes an adaptive immune response to the tumor.

d. Deletion of Genes in the LPS Biosynthetic Pathway

The lipopolysaccharide (LPS) of Gram-negative bacteria is the major component of the outer leaflet of the bacterial membrane. It is composed of three major parts, lipid A, a nonrepeating core oligosaccharide, and the O antigen (or O polysaccharide). O antigen is the outermost portion on LPS and serves as a protective layer against bacterial permeability, however, the sugar composition of O antigen varies widely between strains. The lipid A and core oligosaccharide vary less, and are more typically conserved within strains of the same species. Lipid A is the portion of LPS that contains endotoxin activity. It is typically a disaccharide decorated with multiple fatty acids. These hydrophobic fatty acid chains anchor the LPS into the bacterial membrane, and the rest of the LPS projects from the cell surface.

The lipid A domain is responsible for much of the toxicity of Gram-negative bacteria. Typically, LPS in the blood is recognized as a significant pathogen associated molecular pattern (PAMP), and induces a profound pro-inflammatory response. LPS is the ligand for a membrane-bound receptor complex comprising CD14, MD2 and TLR4. TLR4 is a transmembrane protein that can signal through the MyD88 and TRIF pathways to stimulate the NFκB pathway and result in the production of pro-inflammatory cytokines, such as TNF-α and IL-1β, the result of which can be endotoxic shock, which can be fatal. LPS in the cytosol of mammalian cells can bind directly to the CARD domains of caspases 4, 5, and 11, leading to autoactivation and pyroptotic cell death (Hagar et al. (2015) *Cell Research* 25:149-150).

The composition of lipid A and the toxigenicity of lipid A variants is well documented. For example, a monophosphorylated lipid A is much less inflammatory than lipid A with multiple phosphate groups. The number and length of the acyl chains on lipid A also can have a profound impact on the degree of toxicity. Canonical lipid A from *E. coli* has six acyl chains, and this hexa-acylation is potently toxic. *S. typhimurium* lipid A is similar to that of *E. coli*; it is a glucosamine disaccharide that carries four primary and two secondary hydroxyacyl chains (Raetz and Whitfield (2002) *Annu. Rev. Biochem.* 71:635-700). As described above, msbB$^-$ mutants of *S. typhimurium* cannot undergo the terminal myristoylation of LPS, and produce predominantly penta-acylated lipid A that is significantly less toxic than hexa-acylated lipid A. The modification of lipid A with palmitate is catalyzed by palmitoyl transferase (PagP). Transcription of the pagP gene is under control of the phoP/phoQ system, which is activated by low concentrations of magnesium, e.g., inside the SCV. Thus, the acyl content of *S. typhimurium* is variable, and with wild-type bacteria, it can be hexa- or penta-acylated. The ability of *S. typhimurium* to palmitate its lipid A increases resistance to antimicrobial peptides that are secreted into phagolysozomes.

In wild-type *S. typhimurium*, expression of pagP results in a lipid A that is hepta-acylated. In an msbB$^-$ mutant (in which the terminal acyl chain of the lipid A cannot be added), the induction of pagP results in a hexa-acylated LPS (Kong et al. (2011) *Infection and Immunity* 79(12):5027-5038). Hexa-acylated LPS has been shown to be the most pro-inflammatory. While other groups have sought to exploit this pro-inflammatory signal, for example, by deletion of pagP to allow only hexa-acylated LPS to be produced (Felgner et al. (2016) *Gut Microbes* 7(2):171-177; Felgner et al. (2018) *Oncoimmunology* 7(2): e1382791), this can lead to poor tolerability, due to the TNF-α-mediated pro-inflammatory nature of the LPS and paradoxically less adaptive immunity (Kocijancic et al. (2017) *Oncotarget* 8(30):49988-50001).

LPS is a potent TLR4 agonist that induces TNF-α and IL-6. The dose-limiting toxicities in the I.V. VNP20009 clinical trial (Toso et al. (2002) *J Clin. Oncol.* 20(1):142-152) at 1E9 CFU/m$^2$ were cytokine mediated (fever, hypotension), with TNF-α levels >100,000 pg/ml and IL-6 levels >10,000 pg/ml in serum at 2 hours. Despite the msbB deletion in VNP20009 and its reduced pyrogenicity, the LPS still can be toxic at high doses, possibly due to the presence of hexa-acylated LPS. Thus, a pagP$^-$/msbB$^-$ strain is better tolerated at higher doses, as it cannot produce hexa-acylated LPS, and will allow for dosing in humans at or above 1E9 CFU/m$^2$. Higher dosing can lead to increased tumor colonization, enhancing the therapeutic efficacy of the immunostimulatory bacteria.

Herein, *Salmonella* bacteria, such as *S. typhimurium*, are engineered to lack both flagellin subunits fliC and fljB, to reduce pro-inflammatory signaling. For example, as shown herein, a *Salmonella* strain lacking msbB, which results in reduced TNF-alpha induction, is combined with fliC and fljB knockouts. This results in a *Salmonella* strain that has a combined reduction in TNF-alpha induction and reduction in TLR5 recognition. These modifications can be combined with pagP⁻ and other genomic modifications discussed herein, and the resulting bacterial strain can be transformed with an immunostimulatory plasmid (encoding immunostimulatory protein(s)), optionally containing CpGs. The resulting bacteria have reduced pro-inflammatory signaling, but robust anti-tumor activity.

Exemplified herein, are live attenuated *Salmonella* strains, such as the exemplary strain of *S. typhimurium*, that only can produce penta-acylated LPS, that contain a deletion of the msbB gene (that prevents the terminal myristoylation of lipid A, as described above), and that further are modified by deletion of pagP (preventing palmitoylation). A strain modified to produce penta-acylated LPS will allow for lower levels of pro-inflammatory cytokines, improved stability in the blood and resistance to complement fixation, increased sensitivity to antimicrobial peptides, enhanced tolerability, and increased anti-tumor immunity when further modified to express a therapeutic product(s), such as heterologous immune-stimulatory proteins and/or interfering RNAs against, for example, immune checkpoints.

As provided herein, for example, a pagP⁻ mutant also can be constructed on an asd, msbB, purI/purM and fliC/fljB deleted strain of *S. typhimurium* VNP20009, or other strains as described herein, or wild-type *S. typhimurium*. The resulting strains are exemplary of strains that are attenuated for bacterial inflammation by modification of lipid A to reduce TLR2/4 signaling, and deletion of the flagellin subunits to reduce TLR5 recognition and inflammasome induction, and deletion of pagP to produce penta-acylated LPS. Deletion of the flagellin subunits combined with modification of the LPS allows for greater tolerability in the host, and greater stability in the blood and resistance to complement fixation, providing for improved trafficking to the tumor site, in order to direct the immunostimulatory response towards production of any gene product, such as immunostimulatory proteins, and/or delivery of RNA interference against desired targets in the TME to elicit an anti-tumor response and promote an adaptive immune response to the tumor.

e. Deletions in Genes Required for Biofilm Formation

Bacteria and fungi are capable of forming multicellular structures called biofilms. Bacterial biofilms are encased within a mixture of secreted and cell wall-associated polysaccharides, glycoproteins, and glycolipids, as well as extracellular DNA, known collectively as extracellular polymeric substances. These extracellular polymeric substances protect the bacteria from multiple insults, such as cleaning agents, antibiotics, and antimicrobial peptides. Bacterial biofilms allow for colonization of surfaces, and are a cause of significant infection of prosthetics, such as injection ports and catheters. Biofilms also can form in tissues during the course of an infection, which leads to increases in the duration of bacterial persistence and shedding, and limits the effectiveness of antibiotic therapies. Chronic persistence of bacteria in biofilms is associated with increased tumorigenesis, for example in *S. typhi* infection of the gall bladder (Di Domenico et al. (2017) *Int. J. Mol. Sci.* 18:1887).

*S. typhimurium* biofilm formation is regulated by CsgD. CsgD activates the csgBAC operon, which results in increased production of the curli fimbrial subunits CsgA and CsgB (Zakikhany et al. (2010) *Molecular Microbiology* 77(3):771-786). CsgA is recognized as a PAMP by TLR2 and induces production of IL-8 from human macrophages (Tukel et al. (2005) *Molecular Microbiology* 58(1):289-304). Further, CsgD indirectly increases cellulose production by activating the adrA gene that encodes for di-guanylate cyclase. The small molecule cyclic di-guanosine monophosphate (c-di-GMP) generated by AdrA is a ubiquitous secondary messenger found in almost all bacterial species. The AdrA-mediated increase in c-di-GMP enhances expression of the cellulose synthase gene bcsA, which in turn increases cellulose production via stimulation of the bcsABZC and bcsEFG operons. Reduction in the capability of immunostimulatory bacteria, such as *S. typhimurium*, to form biofilms can be achieved through deletion of genes involved in biofilm formation, such as, for example, csgD, csgA, csgB, adrA, bcsA, bcsB, bcsZ, bcsE, bcsF, bcsG, dsbA or dsbB (Anwar et al. (2014) *PLoS One* 9(8):e106095).

*S. typhimurium* can form biofilms in solid tumors as protection against phagocytosis by host immune cells. *Salmonella* mutants that cannot form biofilms are taken up more rapidly by host phagocytic cells and are cleared from infected tumors (Crull et al. (2011) *Cellular Microbiology* 13(8):1223-1233). This increase in intracellular localization within phagocytic cells can reduce the persistence of extracellular bacteria, and enhance the effectiveness of plasmid delivery, expression and release of encoded therapeutic products into the TME, as well as gene knockdown by RNA interference, as described herein. Immunostimulatory bacteria engineered to reduce biofilm formation, will increase clearance rate from tumors/tissues and therefore increase the tolerability of the therapy, and will prevent colonization of prosthetics in patients, thereby increasing the therapeutic benefit of these strains. Adenosine mimetics can inhibit *S. typhimurium* biofilm formation, indicating that the high adenosine concentration in the tumor microenvironment can contribute to tumor-associated biofilm formation (Koopman et al. (2015) *Antimicrob Agents Chemother* 59:76-84). As provided herein, live attenuated strains of bacteria, such as *S. typhimurium*, that contain a purI disruption (and therefore, colonize adenosine-rich tumors), and are also prevented from forming biofilms by deletion of one or more genes required for biofilm formation, are engineered to deliver plasmids encoding therapeutic products, such as cytosolic DNA/RNA sensors and gain-of-function variants thereof, and other immunostimulatory proteins, such as cytokines, and interfering RNA, to stimulate a robust anti-tumor immune response.

The adrA gene encodes a di-guanylate cyclase that produces c-di-GMP, which is required for *S. typhimurium* biofilm formation. c-di-GMP binds to and is an agonist for the host cytosolic protein STING. Immunostimulatory bacteria that are reduced in c-di-GMP production via the deletion of adrA is counterintuitive, but bacterial mutants, such as *S. typhimurium* mutants, that are unable to form biofilms (including adrA mutants), have demonstrated reduced therapeutic potential in mouse tumor models (Crull et al. (2011) *Cellular Microbiology* 13(8):1223-1233). Several human alleles of STING are refractory to binding bacterially-produced 3'3' CDNs (Corrales et al. (2015) *Cell Reports* 11:1018-1030).

As described herein, bacterial strains, such as *S. typhimurium* strains, that are engineered to be adenosine auxotrophic, and are reduced in their ability to induce pro-inflammatory cytokines by modification of the LPS and/or deletion of flagellin, and/or deletion of genes required for biofilm formation, are further modified to deliver interfering RNAs, and other therapeutic, anti-cancer products, such as immunostimulatory proteins, including cytosolic DNA/RNA sensors and gain-of-function variants thereof (e.g., STING and others) and cytokines, to promote robust anti-tumor immune responses.

f. *Salmonella* Engineered to Escape the *Salmonella* Containing Vacuole (SCV)

*Salmonella*, such as *S. typhimurium*, are intracellular pathogens that replicate primarily in a membrane bound compartment called a *Salmonella* containing vacuole (SCV). In some epithelial cell lines, and at a low frequency, *S. typhimurium* have been shown to escape into the cytosol where they can replicate. *Salmonella* engineered to escape the SCV with higher efficiency will be more efficient at delivering macromolecules, such as plasmids, to the host cell cytosol, as the lipid bilayer of the SCV is a potential barrier. Plasmid release into the host cytosol allows for the expression of therapeutic products encoded on the plasmid, that are under the control of host-recognized regulatory signals, such as eukaryotic promoters, increasing the efficiency of production and delivery of the therapeutic products to the TME, particularly when the bacteria are phagocytosed by tumor-resident immune cells, and improving the therapeutic index of the bacteria.

Provided herein are *Salmonella* strains and methods that have enhanced frequency of SCV escape. As discussed below and elsewhere herein, this is achieved by deletion of genes required for *Salmonella* induced filament (SIF) formation. These mutants have an increased frequency of SCV escape and can replicate in the cytosol of the host cell. For example, enhanced plasmid delivery using a sifA mutant of *S. typhimurium* has been demonstrated. The sifA gene encodes an SPI-2 T3SS-2 secreted effector protein that mimics or activates a RhoA family of host GTPases (Ohlson et al. (2008) *Cell Host & Microbe* 4:434-446). Other genes encoding secreted effectors involved in SIF formation can be targeted. These include, for example, sseJ, sseL, sopD2, pipB2, sseF, sseG, spvB, and steA. Enhancing the escape of *S. typhimurium* by prevention of SIF formation releases live bacteria into the cytosol, where they can replicate.

Another method to enhance *S. typhimurium* escape from the SCV and increase the delivery of macromolecules such as plasmids to the cytosol, is the expression of a heterologous hemolysin that results in pore formation in, or rupture of, the SCV membrane. One such hemolysin is the Listeriolysin O protein (LLO) from *Listeria monocytogenes*, which is encoded by the hlyA gene. LLO is a cholesterol-dependent pore-forming cytolysin that is secreted from *L. monocytogenes* and is primarily responsible for phagosomal escape and entry into the cytosol of host cells. Secretion of LLO from *S. typhimurium* can result in bacterial escape and lead to replication in the cytosol. To prevent intact *S. typhimurium* from escaping the SCV and replicating in the cytosol, the nucleotides encoding the secretion signal sequence can be removed from the gene, producing cytoLLO. In this manner, the active LLO is contained within the cytoplasm of the *S. typhimurium* and LLO is only released when the bacteria undergo lysis (for example, due to the lack of intracellular DAP in an asd$^-$ strain). Bacterial lysis in the SCV allows for the release of the plasmid and accumulated cytoLLO, which will form pores in the SCV, allowing for the delivery of the plasmid into the host cell cytosol, where the encoded therapeutic product(s) can be expressed.

As provided herein, *Salmonella* strains, such as the *S. typhimurium* strain VNP20009, engineered to express cytoLLO to enhance delivery of plasmids for expression of therapeutic products, such as STING proteins and variants thereof, and other immunostimulatory proteins, can increase the therapeutic potency of the immunostimulatory bacteria. This is advantageous, where the bacteria are engineered to accumulate in tumor-resident immune cells, as herein, whereby the expressed therapeutic products are released directly into the tumor microenvironment.

g. Deletions of SPI-1 and SPI-2 Genes and/or Other Genes to Eliminate the Ability of the Bacteria to Infect Epithelial Cells, Including Deletion of Flagella As described above, pathogenesis, in certain bacterial species, including *Salmonella* species, such as *S. typhimurium*, involves a cluster of genes referred to as *Salmonella* pathogenicity islands (SPIs). *S. typhimurium* is an intracellular pathogen that is rapidly taken up by myeloid cells, such as macrophages, or it can induce its own uptake in non-phagocytic cells, such as epithelial cells. Once inside cells, it can replicate within a *Salmonella* containing vacuole (SCV) and can also escape into the cytosol of some epithelial cells. The two best characterized pathogenicity islands are SPI-1, which is responsible for mediating bacterial invasion of non-phagocytic cells, such as epithelial cells, and SPI-2, which is required for replication within the SCV (Agbor and McCormick (2011) *Cell Microbiol.* 13(12): 1858-1869). SPI-1 and SPI-2 encode macromolecular structures called type three secretion systems (T3SS) that can translocate effector proteins across the host membrane (Galan and Wolf-Watz (2006) *Nature* 444:567-573).

i. *Salmonella* Pathogenicity Island 1 (SPI-1)

SPI-1-Dependent Host Cell Invasion

The invasion-associated *Salmonella* pathogenicity island 1 (SPI-1), including the type 3 secretion system (T3SS), is responsible for the translocation of effector proteins into the cytosol of host cells, causing actin rearrangements that lead to the uptake of *Salmonella*. *Salmonella* invades non-phagocytic intestinal epithelial cells using a type 3 secretion system (T3SS) encoded by SPI-1, which forms a needle-like structure that injects effector proteins directly into the cytosol of host cells. These effector proteins lead to rearrangement of the eukaryotic cell cytoskeleton to facilitate invasion of the intestinal epithelium, and also induce proinflammatory cytokines. The SPI-1 locus includes 39 genes that encode components of this invasion system (see, e.g., Kimbrough et al. (2002) *Microbes Infect.* 4(1):75-82). SPI-1 genes comprise a number of operons, including: sitABCD, sprB, avrA, hilC, orgABC, prgKJIH, hilD, hilA, iagB, sptP, sicC, iacP, sipADCB, sicA, spaOPQRS, invFGEABCIJ, and invH. The operons and genes and their functions are described and depicted, for example, in Kimbrough et al. ((2002) *Microbes Infect.* 4(1):75-82). SPI-1 genes include, but are not limited to: avrA, hilA, hilD, invA, invB, invC, invE, invF, invG, invH, invI, invJ, iacP, iagB, spaO, spaP, spaQ, spaR, spaS, orgA, orgB, orgC, prgH, prgI, prgJ, prgK, sicA, sicP, sipA, sipB, sipC, sipD, sirC, sopB, sopD, sopE, sopE2, sprB, and sptP.

T3SSs are complexes that play a large role in the infectivity of Gram-negative bacteria, by injecting bacterial protein effectors directly into host cells in an ATP-dependent manner. T3SS complexes cross the inner and outer bacterial membranes and create a pore in eukaryotic cell membranes upon contact with a host cell. They consist of an exportation apparatus, a needle complex and a translocon at the tip of the needle (see, e.g., Kimbrough et al. (2002) *Microbes Infect.* 4(1):75-82). The needle complex includes the needle protein PrgI, a basal body, which anchors the complex in the bacterial membranes and consists of the proteins PrgH, PrgK and InvG, and other proteins, including InvH, PrgJ (rod protein) and InvJ. The translocon, which forms the pore in the host cell, is a complex of the proteins SipB, SipC and SipD. The exportation apparatus, which allows for the translocation of the effector proteins, is comprised of the proteins SpaP, SpaQ, SpaR, SpaS, InvA, InvC and OrgB. A cytoplasmic sorting platform, which establishes the specific order of protein secretion, is composed of the proteins SpaO, OrgA and OrgB (see, e.g., Manon et al. (2012), *Salmonella*, Chapter 17, eds. Annous and Gurtler, Rijeka, pp. 339-364).

The effectors translocated into the host cell by T3SS-1 (T3SS of SPI-1) include SipA, SipC, SopB, SopD, SopE, SopE2 and SptP, which are essential for cell invasion. For example, *S. typhimurium* sipA mutants exhibit 60-80% decreased invasion, sipC deletion results in a 95% decrease in invasion, and sopB deletion results in a 50% decrease in invasion (see, e.g., Manon et al. (2012), *Salmonella, Chapter* 17, eds. Annous and Gurtler, Rijeka, pp. 339-364). Other effectors include AvrA, which controls *Salmonella*-induced inflammation. Chaperones, which bind secreted proteins and maintain them in a conformation that is competent for secretion, include SicA, InvB and SicP. Transcriptional regulators include HilA, HilD, InvF, SirC and SprB. Unclassified T3SS SPI-1 proteins, which have various functions in type III secretion, include OrgC, InvE, InvI, IacP and IagB (see, e.g., Kimbrough et al. (2002) *Microbes Infect.* 4(1): 75-82).

The SPI-1 T3SS is essential for crossing the gut epithelial layer, but is dispensable for infection when bacteria are injected parenterally. The injection of some proteins (e.g., PrgI and PrgJ) and the needle complex itself also can induce inflammasome activation and pyroptosis of phagocytic cells. This pro-inflammatory cell death can limit the initiation of a robust adaptive immune response by directly inducing the death of antigen-presenting cells (APCs), as well as modifying the cytokine milieu to prevent the generation of memory T-cells. Thus, the inactivation of SPI-1-dependent invasion, through the inactivation or knockout of one or more genes involved in SPI-1, eliminates the ability of the bacteria to infect epithelial cells, but does not affect their ability to infect or invade phagocytic cells, including phagocytic immune cells, such as tumor-associated myeloid cells. These SPI-1 genes include, but are not limited to, one more of: avrA, hilA, hilD, invA, invB, invC, invE, invF, invG, invH, invI, invJ, iacP, iagB, spaO, spaP, spaQ, spaR, spaS, orgA, orgB, orgC, prgH, prgI, prgJ, prgK, sicA, sicP, sipA, sipB, sipC, sipD, sirC, sopB, sopD, sopE, sopE2, sprB, and sptP.

SPI-1-Independent Host Cell Invasion

*Salmonella* mutants lacking the T3SS-1 have been shown to invade numerous cell lines/types, by a T3SS-1 independent invasion mechanism, involving several proteins, including the invasions Rck, PagN and HlyE. The rck operon contains 6 open reading frames: pefI, srgD, srgA, srgB, rck and srgC pefI encodes a transcriptional regulator of the pef operon, which is involved in the biosynthesis of the Pef fimbriae. These fimbriae are involved in biofilm formation, adhesion to murine small intestine and fluid accumulation in the infant mouse. SrgA oxidizes the disulfide bond of PefA, the major structural subunit of the Pef fimbriae. srgD encodes a putative transcriptional regulator; SrgD together with PefI work to induce a synergistic negative regulation of flagellar gene expression. srgB encodes a putative outer membrane protein, and srgC encodes a putative transcriptional regulator (see, e.g., Manon et al. (2012), *Salmonella*, Chapter 17, eds. Annous and Gurtler, Rijeka, pp. 339-364).

Rck is a 17 kDa outer membrane protein encoded by the large virulence plasmid of *S. Enteritidis* and *S. Typhimurium*, that induces adhesion to and invasion of epithelial cells, and confers a high level of resistance to neutralization by complement, by preventing the formation of the membrane attack complex. An rck mutant exhibited a 2-3 fold decrease in epithelial cell invasion compared to the wild-type strain, while Rck overexpression leads to increased invasion. Rck induces cell entry by a receptor-mediated process, promoting local actin remodeling and weak and closely adherent membrane extensions. Thus, *Salmonella* can enter cells by two distinct mechanisms: the Trigger mechanism mediated by the T3SS-1 complex, and a Zipper mechanism induced by Rck (see, e.g., Manon et al. (2012), *Salmonella*, Chapter 17, eds. Annous and Gurtler, Rijeka, pp. 339-364).

The invasin PagN is an outer membrane protein that has also been shown to play a role in *Salmonella* invasion. pagN expression is regulated by phoP. Specific stimuli, for example, acidified macrophage phagosome environments or low $Mg^{2+}$ concentrations, are sensed by PhoQ, which then activates PhoP to regulate specific genes. It has been shown that the deletion of pagN in *S. typhimurium* results in a 3-fold decrease in the invasion of enterocytes, without altering cell adhesion. Although the PagN-mediated entry mechanism is not fully understood, it has been shown that actin polymerization is required for invasion. Studies have shown that PagN is required for *Salmonella* survival in BALB/c mice, and that a pagN mutant is less competitive for colonizing the spleen of mice than the parent strain. Because pagN is activated by PhoP, it is mostly expressed intracellularly, where the SPI-1 island encoding T3SS-1 is down-regulated. It is thus possible that bacteria exiting epithelial cells or macrophages have an optimal level of PagN expression, but have low T3SS-1 expression, which can mediate subsequent interactions with other cells encountered following host cell destruction, indicating a role for PagN in *Salmonella* pathogenesis (see, e.g., Manon et al. (2012), *Salmonella*, Chapter 17, eds. Annous and Gurtler, Rijeka, pp. 339-364).

hlyE shares more than 90% sequence identity with the *E. coli* HlyE (ClyA) hemolysin. The HlyE protein lyses epithelial cells when exported from bacterial cells via outer membrane vesicle release, and is involved in epithelial cell invasion. HlyE also is involved in the establishment of systemic *Salmonella* infection (see, e.g., Manon et al. (2012), *Salmonella*, Chapter 17, eds. Annous and Gurtler, Rijeka, pp. 339-364).

As a result, elimination of the bacterium's ability to infect epithelial cells also can be achieved by engineering the immunostimulatory bacteria herein to contain knockouts or deletions/disruptions of genes encoding proteins involved in SPI-1-independent invasion, such as one or more of the genes rck, pagN, hlyE, pefI, srgD, srgA, srgB, and srgC.

The immunostimulatory bacteria provided herein include those with deletion or disruption of the hilA gene and/or other genes in the T3SS pathway. When these bacteria are administered, such as intravenously or intratumorally, infection is focused towards phagocytic cells, such as macrophages and dendritic cells, that do not require the SPI-1 T3SS for uptake. This enhances the safety profile of the immunostimulatory bacteria provided herein. It prevents off-target cell invasion and prevents fecal-oral transmission. In addition to reducing the uptake of *Salmonella* by non-phagocytic cells, such as epithelial cells, deletion or disruption of genes in this pathway also prolongs the longevity of the phagocytic cells, by preventing inflammasome activation and pyroptosis in macrophages, thus, inducing less cell death in human macrophages, compared to bacteria that do not contain a deletion in this pathway. For example, deletion of genes in the SPI-1 pathway (such as, for example, the needle and rod proteins) can prevent pyroptosis by preventing inflammasome activation, but maintains TLR5 signaling. This, in turn, permits prolonged secretion of encoded proteins, such as the STING proteins or other therapeutic/anti-cancer products encoded by the immunostimulatory bacteria provided herein, and permits macrophage trafficking to tumors, thus improving the efficacy of the immunostimulatory bacteria.

As described herein, provided are immunostimulatory bacteria that are modified so that they do not infect epithelial cells, but retain the ability to infect phagocytic cells, including tumor-resident immune cells, thereby effectively targeting the immunostimulatory bacteria, and the encoded therapeutic products, to the tumor microenvironment. This is achieved by deleting or knocking out any of the proteins in SPI-1, including, but not limited to, deletions of one more of: avrA, hilA, hilD, invA, invB, invC, invE, invF, invG, invH, invI, invJ, iacP, iagB, spaO, spaP, spaQ, spaR, spaS, orgA, orgB, orgC, prgH, prgI, prgJ, prgK, sicA, sicP, sipA, sipB, sipC, sipD, sirC, sopB, sopD, sopE, sopE2, sprB, and sptP, as well as one or more of rck, pagN, hlyE, peg srgD, srgA, srgB, and srgC.

The immunostimulatory bacteria that do not infect epithelial cells can be further modified as described herein, to encode therapeutic products that stimulate the immune system, including, for example, products that induce type I interferon (e.g., cytosolic DNA/RNA sensors and GOF variants thereof), and also to encode immunostimulatory proteins, such as cytokines. The bacteria generally have an asd deletion to render them unable to replicate in a mammalian host. For example, provided are strains of *S. typhimurium* modified by deletion of one or more SPI-1 genes, and also modified by one or more of a purI deletion, an msbB deletion, and an asd deletion, and further modified by delivering plasmids encoding therapeutic products, such as proteins that stimulate the immune system, such as cytosolic DNA/RNA sensors and gain-of-function mutants thereof, that induce type I interferon, and/or immunostimulatory cytokines.

For example, bacteria with deletions of a regulatory gene (e.g., hilA or invF) required for expression of the SPI-1-associated type 3 secretion system (T3SS-1), a T3SS-1 structural gene (e.g., invG or prgH), and/or a T3SS-1 effector gene (e.g., sipA or avrA) are provided. As discussed above, this secretion system is responsible for injecting effector proteins into the cytosol of non-phagocytic host cells, such as epithelial cells, that cause the uptake of the bacteria; deletion of one or more of these genes eliminates infection/invasion of epithelial cells. Deletion of one or more of the genes, such as hilA, provides immunostimulatory bacteria that can be administered intravenously or intratumorally, resulting in infection of phagocytic cells, which do not require the SPI-1 T3SS for uptake, and also prolongs the longevity of these phagocytic cells. The hilA mutation also reduces the quantity of pro-inflammatory cytokines, increasing the tolerability of the therapy, as well as the quality of the adaptive immune response.

Additionally or alternatively, the immunostimulatory bacteria can contain knockouts or deletions in genes to inactivate products involved in SPI-1-independent infection/invasion, such as one or more of the genes pagN, hlyE, pefI, srgD, srgA, srgB, and srgC, reducing or eliminating the bacterium's ability to infect epithelial cells.

As described herein, genes involved in the SPI-1 pathway, and bacterial flagella, activate the inflammasome in phagocytic cells (immune cells), triggering pyroptosis. Knocking out or disrupting SPI-1 genes and genes that encode flagella, decreases or eliminates pyroptosis, and also, eliminates infection of epithelial cells, resulting in increased infection of phagocytic cells. Thus, the immunostimulatory bacteria can contain knockouts or deletions to inactivate products of genes that induce cell death of tumor-resident immune cells, such as genes that encode proteins that are directly recognized by the inflammasome; these include fljB, fliC, prgI and prgJ. As shown herein (see, e.g., Example 6), elimination of the flagella (i.e., in *Salmonella*, fliC$^-$/fljB$^-$), decreases pyroptosis in murine macrophages and in human monocytes, results in an inability to infect epithelial cells, and restricts uptake of the bacteria to tumor-resident immune/myeloid cells.

Hence, provided are immunostimulatory bacteria that accumulate in phagocytic cells, particularly tumor-resident immune cells, in which they express products encoded on plasmids that are controlled by eukaryotic regulatory signals, such as RNA polymerase II. Products include those that evoke immune responses, such as through pathways that increase expression of type I interferons, which increase the host immune response in the tumor microenvironment. The immunostimulatory bacteria also can encode other products, including immunostimulatory proteins, such as IL-2, further enhancing the immune response in the tumor microenvironment.

ii. *Salmonella* Pathogenicity Island 2 (SPI-2)

*Salmonella* also have a *Salmonella* pathogenicity island 2 (SPI-2), encoding another T3SS that is activated following entry of the bacterium into the host cell, and interferes with phagosome maturation, resulting in the formation of a specialized *Salmonella*-containing vacuole (SCV), where the *Salmonella* resides during intracellular survival and replication. SPI-2 T3SS effectors include SseB, SseC, SseD and SpiC, which are responsible for assembly of the F-actin coat around intracellular bacteria; this actin coat promotes fusion of the SCV with actin-containing or actin-propelled vesicles, and prevents it from fusing with unfavorable compartments. SifA is responsible for the formation of *Salmonella*-induced filaments (SIFs), which are tubules that connect the individual SCVs in the infected cell. SifA is essential to maintaining the integrity of the SCV, and sifA mutants are released into the cytosol of host cells. SseF and SseG are components of the SPI-2 T3SS that are involved in SCV positioning and cellular trafficking processes that direct materials required for the bacterium's survival and replication, to the SCV. SseF and SseG also are involved in SIF formation. Other SPI-2 T3SS effectors include PipB2, SopD2, and SseJ, which are involved in SIF and SCV formation, and maintenance of vacuole integrity; SpvC, SseL, and SspH1, which are involved in host immune signaling; and SteC, SspH2, SrfH/SseI and SpvB, which are involved in the formation of the SCV F-actin meshwork, in the migration of infected phagocytes, in the inhibition of actin polymerization, and in P-body disassembly in infected cells (Coburn et al. (2007) *Clinical Microbiology Reviews* 20(4):535-549; Figueira and Holden (2012) *Microbiology* 158:1147-1161).

The immunostimulatory bacteria herein can include deletions or modifications in any of the SPI-2 T3SS genes that affect the formation or integrity of the SCV and associated structures, such as SIFs. These mutants have an increased frequency of SCV escape and can replicate in the cytosol. For example, immunostimulatory bacteria, such as *Salmonella* species, engineered to escape the SCV are more efficient at delivering macromolecules, such as plasmids, to the host cell cytosol, as the lipid bilayer of the SCV is a potential barrier. Enhancing the escape of the bacteria from the SCV by prevention of SIF formation releases live bacteria into the cytosol, where they can replicate and express the encoded therapeutic products or proteins under control of the host cell machinery (i.e., under the control of eukaryotic regulatory elements, such as eukaryotic promoters). This enhances the therapeutic efficacy of the bacteria, and is achieved by deletion or mutation of genes required for *Salmonella* induced filament (SIF) formation, including, for example, sifA, sseJ, sseL, sopD2, pipB2, sseF, sseG, spvB, and steA.

The immunostimulatory bacteria that can escape the SCV can be further modified as described herein to encode products that stimulate the immune system, including, for example, products that induce type I interferon, and also to encode cytokines. The bacteria generally have an asd deletion to render them unable to replicate in a mammalian host.

h. Endonuclease-1 (endA) Mutations to Increase Plasmid Delivery

The endA gene (for example, SEQ ID NO:250) encodes an endonuclease (for example, SEQ ID NO:251) that mediates degradation of double stranded DNA (dsDNA) in the periplasm of Gram negative bacteria. Most common strains of laboratory *E. coli* are endA$^-$, as a mutation in the endA gene allows for higher yields of plasmid DNA. This gene is conserved among species. To facilitate intact plasmid DNA delivery, the endA gene of the engineered immunostimulatory bacteria is deleted or mutated to prevent its endonuclease activity. Exemplary of such mutations is an E208K amino acid substitution (Durfee, et al. (2008) *J Bacteriol.* 190(7):2597-2606) or a corresponding mutation in the species of interest. endA, including E208, is conserved among bacterial species, including *Salmonella* (see, e.g., SEQ ID NO:251). Thus, the E208K mutation can be used to eliminate endonuclease activity in other species, including *Salmonella* species. Those of skill in the art can introduce other mutations or deletions to eliminate endA activity. Effecting this mutation, or deleting or disrupting the gene to eliminate activity of the endA in the immunostimulatory bacteria herein, such as in *Salmonella*, increases the efficiency of intact plasmid DNA delivery, thereby increasing expression of the encoded therapeutic product(s) and enhancing anti-tumor efficacy.

i. RIG-I Binding Sequences

As discussed above, type I interferons (IFN-α, IFN-β) are the signature cytokines induced by distinct TLR-dependent and TLR-independent signaling pathways. Of the TLR-independent type I IFN pathways, one is mediated by host recognition of single-stranded (ss) and double-stranded (ds) RNA in the cytosol. These are sensed by RNA helicases, including retinoic acid-inducible gene I (RIG-I), melanoma differentiation-associated gene 5 (MDA-5), and through the IFN-β promoter stimulator 1 (IPS-1) adaptor protein-mediated phosphorylation of the IRF-3 transcription factor, leading to induction of type I IFN (Ireton and Gale (2011) *Viruses* 3(6):906-919). RIG-I recognizes dsRNA and ssRNA bearing 5'-triphosphates. This moiety can directly bind RIG-I, or be synthesized from a poly(dA-dT) template by the poly DNA-dependent RNA polymerase III (Pol III) (Chiu, Y. H. et al. (2009) *Cell* 138(3):576-91). A poly(dA-dT) template containing two AA dinucleotide sequences occurs at the U6 promoter transcription start site in a common lentiviral shRNA cloning vector. Its subsequent deletion in the plasmid prevents type I IFN activation (Pebernard et al. (2004) *Differentiation.* 72:103-111). A RIG-I binding sequence can be included in the plasmids provided herein; this inclusion can increase immunostimulation, by inducing type I IFN production, that increases anti-tumoral activity of the immunostimulatory bacteria herein.

j. DNase II Inhibition

Another nuclease responsible for degrading foreign and self DNA is DNase II, an endonuclease, which resides in the endosomal compartment and degrades DNA following apoptosis. Lack of DNase II (Dnase2a in mice) results in the accumulation of endosomal DNA that escapes to the cytosol and activates cGAS/STING signaling (Lan Y. Y. et al. (2014) *Cell Rep.* 9(1):180-192). DNase II-deficiency in humans presents with autoimmune type I interferonopathies. In cancer, dying tumor cells that are engulfed by tumor-resident macrophages prevent cGAS/STING activation, and potential autoimmunity, through DNase II digestion of DNA within the endosomal compartment (Ahn et al. (2018) *Cancer Cell* 33:862-873). Hence, embodiments of the immunostimulatory bacterial strains, as provided herein, which encode products that can inhibit DNase II in the tumor microenvironment, can provoke accumulation of endocytosed apoptotic tumor DNA in the cytosol, where it can act as a potent cGAS/STING agonist.

k. RNase 112 Inhibition

While TREX1 (three-prime repair exonuclease 1) and DNase II function to clear aberrant DNA accumulation, RNase H2 functions similarly to eliminate pathogenic accumulation of RNA:DNA hybrids in the cytosol. Deficiencies in RNase H2 also contribute to the autoimmune phenotype of Aicardi-Goutières syndrome (Rabe, B. (2013) *J. Mol. Med.* 91:1235-1240). Loss of RNase H2 and subsequent accumulation of RNA:DNA hybrids or genome-embedded ribonucleotide substrates has been shown to activate cGAS/STING signaling (MacKenzie et al. (2016) *EMBO J.* April 15; 35(8):831-44). Hence, embodiments of the immunostimulatory bacterial strains that encode products that inhibit or reduce expression of RNase H2, thereby inhibiting RNase H2, result in tumor-derived RNA:DNA hybrids and derivatives thereof, which activate cGAS/STING signaling and enhance anti-tumor immunity.

l. Stabilin-1/CLEVER-1 Inhibition

Another molecule expressed primarily on monocytes, and involved in regulating immunity, is stabilin-1 (gene name STAB1, also known as CLEVER-1, FEEL-1). Stabilin-1 is a type I transmembrane protein that is upregulated on endothelial cells and macrophages following inflammation, and in particular, on tumor-associated macrophages (Kzhyshkowska et al. (2006) *J. Cell. Mol. Med.* 10(3):635-649). Upon inflammatory activation, stabilin-1 acts as a scavenger and aids in wound healing and apoptotic body clearance, and can prevent tissue injury, such as liver fibrosis (Rantakari et al. (2016) *Proc. Natl. Acad. Sci. USA* 113(33):9298-9303). Upregulation of stabilin-1 directly inhibits antigen-specific T-cell responses, and knockdown by siRNA in monocytes was shown to enhance their pro-inflammatory function (Palani, S. et al. (2016) *J. Immunol.* 196:115-123). Hence, embodiments of the immunostimulatory bacterial strains that encode products that inhibit or reduce expression of Stabilin-1/CLEVER-1 in the tumor microenvironment, enhance the pro-inflammatory functions of tumor-resident macrophages.

m. CpG Motifs and CpG Islands

Unmethylated cytidine-phosphate-guanosine (CpG) motifs are prevalent in bacterial, but not vertebrate, genomic DNA. Pathogenic DNA and synthetic oligodeoxynucleotides (ODNs) containing CpG motifs activate host defense mechanisms, leading to innate and acquired immune responses. The unmethylated CpG motifs contain a central unmethylated CG dinucleotide plus flanking regions. In humans, four distinct classes of CpG ODNs have been identified, based on differences in structure and the nature of the immune response they induce. K-type ODNs (also referred to as B-type) contain from 1 to 5 CpG motifs, typically on a phosphorothioate backbone. D-type ODNs (also referred to as A-type) have a mixed phosphodiester/phosphorothioate backbone and have a single CpG motif, flanked by palindromic sequences that permits the formation of a stem-loop structure, as well as poly G motifs at the 3' and 5' ends. C-type ODNs have a phosphorothioate backbone and contain multiple palindromic CpG motifs that can form stem loop structures or dimers. P-Class CpG ODNs have a phosphorothioate backbone and contain multiple CpG motifs with double palindromes that can form hairpins at their GC-rich 3' ends (Scheiermann and Klinman (2014) *Vaccine* 32(48):6377-6389). For purposes herein, the CpGs are encoded in the plasmid DNA; they can be introduced as a motif, or in a gene.

Toll-like receptors (TLRs) are key receptors for sensing pathogen-associated molecular patterns (PAMPs) and activating innate immunity against pathogens (Akira et al. (2001) *Nat. Immunol.* 2(8):675-680). TLR9 recognizes hypomethylated CpG motifs in the DNA of prokaryotes that do not occur naturally in mammalian DNA (McKelvey et al. (2011) *J. Autoimmunity* 36:76-86). Recognition of CpG motifs upon phagocytosis of pathogens into endosomes in immune cell subsets induces IRF7-dependent type I interferon signaling and activates innate and adaptive immunity.

Immunostimulatory bacteria, such as *Salmonella* species, such as *S. typhimurium* strains, carrying plasmids containing CpG islands/motifs, are provided herein. These bacteria can activate TLR9 and induce type I IFN-mediated innate and adaptive immunity. As exemplified herein, bacterial plasmids that contain hypomethylated CpG islands can elicit innate and adaptive anti-tumor immune responses that, in combination with the encoded products, such as the gain-of-function variant STING proteins, can have synergistic or enhanced anti-tumor activity. For example, the asd gene (see, e.g., SEQ ID NO:48) encodes a high frequency of hypomethylated CpG islands. CpG motifs can be included in combination with any of the therapeutic products, such as STING proteins and mutants thereof, described in or apparent from the description herein, in the immunostimulatory bacteria, and thereby enhance or improve the anti-tumor immune response, by modulating TLRs, such as TLR9.

Immunostimulatory CpGs can be included in the plasmids, by including a nucleic acid, typically from a bacterial gene (e.g., asd), that encodes a gene product, and also by adding a nucleic acid that includes CpG motifs. The plasmids herein can include CpG motifs. Exemplary CpG motifs are known (see, e.g., U.S. Pat. Nos. 8,232,259, 8,426,375 and 8,241,844). These include, for example, synthetic immunostimulatory oligonucleotides, between 10 and 100, 10 and 20, 10 and 30, 10 and 40, 10 and 50, or 10 and 75 base pairs long, with the general formula:

$(CpG)_n$, where $n$ is the number of repeats.

Generally, at least one or two repeats are used; non-CG bases can be interspersed. Those of skill in the art are very familiar with the general use of CpG motifs for inducing an immune response by modulating TLRs, particularly TLR9.

5. Modifications that Increase Uptake of Gram-Negative Bacteria, Such as *Salmonella*, by Immune Cells, and Reduce Immune Cell Death The immunostimulatory bacteria provided herein, such as the exemplary strains of *S. typhimurium*, can be modified to increase uptake by immune cells, such as tumor-resident immune cells, and to decrease uptake by non-immune cells, such as epithelial cells. The bacteria also can be modified to decrease immune cell death, such as by decreasing macrophage pyroptosis. Numerous modifications of the bacterial genome can do one or both of increasing infection of immune cells and decreasing pyroptosis. The immunostimulatory bacteria provided herein include such modifications, for example, deletions and/or disruptions of genes involved in the SPI-1 T3SS pathway, such as disruption or deletion of hilA, rod protein and/or needle protein, and/or disruption/deletion of other bacterial genes, encoding flagellin. These modifications allow the bacteria to accumulate in tumor-resident immune cells, where they can express the encoded therapeutic product(s) and release them directly into the tumor microenvironment, enhancing the therapeutic efficacy. Additionally, prolonging the life of tumor-resident macrophages, e.g., by decreasing pyroptosis, allows for the efficient production of the encoded therapeutic products, and activation of an immune response in the tumor microenvironment, further enhancing the anti-tumor therapeutic efficacy of the bacteria.

a. Bacterial Uptake by Immune Cells

The genome of the immunostimulatory bacteria provided herein can be modified to increase or promote infection of immune cells, particularly immune cells in the tumor microenvironment, such as phagocytic cells. This includes reducing infection of non-immune cells, such as epithelial cells, or increasing infection of immune cells. The invasive phenotype of Gram-negative bacteria, such as *Salmonella*, can result from the activity of genes encoded in pathways that promote the invasion of host cells. The invasion-associated *Salmonella* pathogenicity island 1 (SPI-1) of *Salmonella* is exemplary. SPI-1 includes the type 3 secretion system (T3SS), that is responsible for translocation of effector proteins into the cytosol of host cells. These proteins can cause actin rearrangements that lead to the uptake of *Salmonella*. T3SS effectors mediate the uptake of *S. typhimurium* into non-phagocytic host cells, such as epithelial cells. The SPI-1 T3SS has been shown to be essential for crossing the gut epithelial layer, but is dispensable for infection when bacteria are injected parenterally, for example. SPI-1 mutants have defects in epithelial cell invasion, dramatically reducing oral virulence, but are taken up normally by phagocytic cells, such as macrophages (Kong et al. (2012) *Proc. Natl. Acad. Sci. U.S.A.* 109(47):19414-19419).

The immunostimulatory bacteria, such as *S. typhimurium* strains, provided herein, can be engineered with mutations in SPI-1 T3SS genes, preventing their uptake by epithelial cells, and focusing them to immune cells, such as macrophages, such as tumor-associated macrophages, enhancing the anti-tumor immune response. Additionally, as shown herein (see, e.g., Example 6), elimination of the flagella, results in an inability to infect epithelial cells, and restricts uptake of the bacteria to tumor-resident immune/myeloid cells. Thus, in embodiments herein, the immunostimulatory bacteria can be modified by deletion or disruption of genes in the SPI-1 T3SS and/or by deletion or disruption of genes encoding the flagella, to prevent or reduce infection of non-phagocytic cells (e.g., epithelial cells) and increase or restrict infection to tumor-resident myeloid cells. Such bacteria also can be modified with plasmids encoding therapeutic product(s), such as those that induce type I IFN, and immunostimulatory cytokines, further enhancing the anti-tumor immune response and the therapeutic efficacy by expressing the therapeutic products in tumor-resident immune cells.

b. Macrophage Pyroptosis

The macrophage NLRC4 inflammasome, which plays a role in the innate immune and antimicrobial responses, is a large multi-protein complex that recognizes cytosolic pathogens and provides for the autocatalytic activation of caspase-1. Activation of caspase-1 induces maturation and release of the pro-inflammatory cytokines IL-1β and IL-18, and triggers pyroptosis, a rapid inflammatory form of macrophage cell death. This pro-inflammatory cell death can limit the initiation of a robust adaptive immune response by directly inducing the death of antigen-presenting cells (APCs), as well as modifying the cytokine milieu to prevent the generation of memory T-cells.

Infection by certain Gram-negative bacteria encoding type 3 or 4 secretion systems, such as *Salmonella typhimurium* and *Pseudomonas aeruginosa*, triggers the activation of the NLRC4 inflammasome upon recognition of bacterial ligands, such as needle protein, rod protein and flagellin, following translocation into the host cell cytosol by the *Salmonella* pathogenicity island-1 type III secretion system (SPI-1 T3SS). Pyroptosis is not limited to macrophages; caspase-1-dependent death has been observed in dendritic cells following infection with *Salmonella* (Li et al. (2016) *Scientific Reports* 6:37447; Chen et al. (2014) *Cell Reports* 8:570-582; Fink and Cookson (2007) *Cellular Microbiology* 9(11):2562-2570). As shown herein, the knock-out of genes in the *Salmonella* genome that are involved in the induction of pyroptosis enhances the anti-tumor immune response. This prevents the loss of immune cells, including macrophages, following bacterial infection. For example, genes encoding HilA, rod protein (PrgJ), needle protein (PrgI), flagellin and/or QseC can be knocked out/disrupted in the immunostimulatory bacteria provided herein.

i. Flagellin

As discussed above, for some bacteria species, such as *Salmonella*, flagellin, in addition to SPI-1 T3SS, is necessary for triggering pyroptosis in macrophages, and can be detected by, and activate, the macrophage NLRC4 inflammasome. Flagellin, which is the major component of flagellum, is recognized by TLR5. *Salmonella* encodes two flagellin genes, fliC and fljB; elimination of flagellin subunits decreases pyroptosis in macrophages. For example, *S. typhimurium* with deletions in fliC and fljB resulted in significantly reduced IL-1β secretion compared to the wild-type strain, whereas cellular uptake and intracellular replication of the bacterium remained unaffected. This demonstrates that flagellin plays a significant role in inflammasome activation. Additionally, *S. typhimurium* strains engineered to constitutively express FliC were found to induce macrophage pyroptosis (see, e.g., Li et al. (2016) *Scientific Reports* 6:37447; Fink and Cookson (2007) *Cellular Microbiology* 9(11):2562-2570; and Winter et al. (2015) *Infect. Immun.* 83(4):1546-1555).

The genome of the immunostimulatory bacteria herein can be modified to delete, disrupt or mutate the flagellin genes fliC and fljB in *S. typhimurium*, leading to decreased cell death of tumor-resident immune cells, such as macrophages, and enhancing the anti-tumor immune response of the immunostimulatory bacteria.

ii. SPI-1 T3SS Effectors

SPI-1 proteins also activate the NLRC4 inflammasome in macrophages, activating caspase-1 and leading to cell death via pyroptosis. These effectors include, but are not limited to, rod protein (PrgJ) and needle protein (PrgI), for example.

Rod Protein (PrgJ)

The NLRC4 inflammasome also detects a flagellated *S. typhimurium*. The flagellin-independent response is due to the detection of PrgJ, which is the SPI-1 T3SS rod protein in *S. typhimurium*. Delivery of purified PrgJ protein to the macrophage cytosol results in rapid NLRC4-dependent caspase-1 activation, as well as secretion of IL-1β, similar to the effects induced by flagellin (Miao et al. (2010) *Proc. Natl. Acad. Sci. U.S.A.* 107(7):3076-3080). Thus, the mutation or knockout of the gene encoding PrgJ in *S. typhimurium* can reduce macrophage pyroptosis, which enhances the anti-tumor immune effect of the immunostimulatory bacteria, by preserving immune cells that are susceptible to being killed by the bacteria.

Needle Protein (PrgI)

PrgI, which is the SPI-1 T3SS needle protein in *S. typhimurium*, also is recognized by, and activates, the NLRC4 inflammasome. The delivery of *S. typhimurium* PrgI to the cytosol of human primary monocyte-derived macrophages results in IL-1β secretion and subsequent cell death. A *Salmonella* mutant that expresses PrgI, but not flagellin, was shown to activate the inflammasome in primary monocyte-derived macrophages at later time points than strains expressing flagellin (Kortmann et al. (2015) *J. Immunol.* 195:815-819). The immunostimulatory bacteria provided herein, thus, can be modified to mutate or delete the gene encoding the needle protein in *S. typhimurium*, preventing immune cell pyroptosis, and enhancing the anti-tumor immune effect.

iii. QseC

The sensor protein QseC is a highly conserved membrane histidine sensor kinase that is found in many Gram-negative bacteria, and that responds to the environment and regulates the expression of several virulence factors. These virulence factors include, for example, the flhDC gene that encodes the master regulator of flagellum biosynthesis in *S. typhimurium*; the sopB gene, which encodes a protein that plays a role in the invasion of non-phagocytic cells, the early maturation and regulation of trafficking of the *Salmonella*-containing vacuole (SCV), and the inhibition of SCV-lysosome fusion; and the sifA gene, which is required for SCV maintenance and membrane integrity.

It has been shown that selective inhibition of QseC by LED209 inhibits bacterial virulence without suppressing *S. typhimurium* growth, by inhibiting the QseC-mediated activation of virulence-related gene expression (e.g., flhDC, sifA and sopB), and partially protects mice from death following infection with *S. typhimurium* or *Francisella tularensis*. QseC blockade was found to inhibit caspase-1 activation, IL-1β release, and *S. typhimurium*-induced pyroptosis of macrophages, by inhibiting excess inflammasome activation in the infected macrophages. Inhibition of QseC also suppresses flagellar gene expression and motility, and suppresses the invasion and replication capacities of *S. typhimurium* in epithelial cells (Li et al. (2016) *Scientific Reports* 6:37447). Thus, modification of the immunostimulatory bacteria herein, to mutate or knockout the gene encoding QseC, can enhance the anti-tumor immune response by focusing *S. typhimurium* infection to non-epithelial cells, and by reducing cell death in immune cells, such as by preventing pyroptosis in macrophages.

6. Bacterial Culture Conditions

Culture conditions for bacteria can influence their gene expression. It has been documented that *S. typhimurium* can induce rapid pro-inflammatory caspase-dependent cell death of macrophages, but not epithelial cells, within 30 to 60 min of infection, by a mechanism involving the SPI-1 and its associated T3SS-1 (Lundberg et. al (1999) *Journal of Bacteriology* 181(11):3433-3437). It is now known that this cell death is mediated by activation of the inflammasome that subsequently activates caspase-1, which promotes the maturation and release of IL-1β and IL-18 and initiates a novel form of cell death called pyroptosis (Broz and Monack (2011) *Immunol. Rev.* 243(1):174-190). This pyroptotic activity can be induced by using log phase bacteria, whereas stationary phase bacteria do not induce this rapid cell death in macrophages. The SPI-1 genes are induced during the log phase of bacterial growth. Thus, by harvesting *S. typhimurium*, to be used therapeutically, at the stationary phase, rapid pyroptosis of macrophages can be prevented. Macrophages are important mediators of the innate immune system and they can act to secrete cytokines that are critical for establishing appropriate anti-tumor responses. In addition, limiting the secretion of pro-inflammatory cytokines, such as IL-1β and IL-18, will improve the tolerability of administered *S. typhimurium* therapy. As provided herein, immunostimulatory *S. typhimurium*, harvested at stationary phase, will be used to induce anti-tumor responses.

7. Increased Tumor Colonization

VNP20009 is an attenuated *S. typhimurium*-based microbial cancer therapy that was developed for the treatment of cancer. VNP20009 is attenuated through deletion of the genes msbB and purI (purM). The purI deletion renders the microbe auxotrophic for purines or adenosine. Deletion of the msbB gene reduces the toxicity associated with bacterial lipopolysaccharide (LPS), by preventing the addition of a terminal myristyl group to the lipid A domain, and producing a less toxic form of lipid A (Khan et al. (1998) *Mol. Microbiol.* 29:571-579).

There is a difference between mouse and humans in the ability of VNP20009 to colonize tumors. Systemic administration of VNP20009 resulted in colonization of mouse tumors; whereas systemic administration of VNP20009 in human patients resulted in very little tumor colonization. It was shown that in mice, VNP20009 exhibited a high degree of tumor colonization after systemic administration (see, e.g., Clairmont et al. (2000) *J. Infect. Dis.* 181:1996-2002; and Bermudes et al. (2001) *Biotechnol Genet Eng Rev.* 18:219-33). In a Phase 1 Study in advanced melanoma patients, however, very little VNP20009 was detected in human tumors after a 30-minute intravenous infusion (see, Toso et al. (2002) *J. Clin. Oncol.* 20:142-52). Patients that entered into a follow-up study evaluating a longer, four-hour infusion of VNP20009, also demonstrated a lack of detectable VNP20009 after tumor biopsy (Heimann et al. (2003) *J. Immunother.* 26:179-180). Following intratumoral administration, colonization of a derivative of VNP20009 was detected (Nemunaitis et al. (2003) *Cancer Gene Ther.* 10:737-44). Direct intratumoral administration of VNP20009 to human tumors resulted in tumor colonization, indicating that human tumors can be colonized at a high level, and that the difference in tumor colonization between mice and humans occurs only after systemic administration.

Strains, such as VNP20009, are inactivated by human complement, which leads to low tumor colonization. Strains that provide improved resistance to complement are provided herein. These strains contain modifications in the bacterial genome, and also can carry a plasmid, typically in low or medium copy number, to optionally encode genes to provide for replication (asd under the control of a eukaryotic promoter), and nucleic acid(s) encoding a therapeutic product(s), such as, but not limited to, cytokines, gain-of-function mutants of proteins that stimulate production of type I interferon, and other such therapeutic genes/products, as described elsewhere herein.

The table below summarizes the bacterial genotypes/modifications, their functional effects, and the effects/benefits.

| Genotype/Modification | Functional effect | Effects/Benefits |
|---|---|---|
| ΔpurI | Purine/adenosine auxotrophy | Tumor-specific enrichment<br>Limited replication in healthy tissue |
| ΔmsbB | LPS surface coat modification | Decreased TLR4 recognition<br>Reduced immunosuppressive cytokine profile (TNF-α)<br>Improved safety |
| ΔFLG | Flagella knockout | Removes major inflammatory and immune-suppressive element<br>Decreased TLR5 recognition<br>Reduced immunosuppressive cytokine profile<br>Improved safety<br>Reduces ability to invade non-phagocytic cells |
| ΔpagP | LPS surface coat modifications | Removes major inflammatory and immune-suppressive element<br>Decreased TLR4 recognition<br>Reduced IL-6 profile<br>Improved safety |
| Δasd (in genome) | Plasmid maintenance | Improved plasmid delivery<br>Plasmid maintenance |
| plasmid | Express gene products under control of host-recognized promoter | Eukaryotic promoter limits expression to cells containing the plasmid<br>Long term expression in the TME (i.e., asd encoded on plasmid under control of host-recognized promoter)<br>Expression of therapeutic product(s)<br>CpGs to induce type I IFN-mediated innate and adaptive immunity |

Strains provided herein are ΔFLG so that they have no flagella, and/or ΔpagP. Additionally, the strains are one or more of ΔpurI (ΔpurM), ΔmsbB, and Δasd (in the bacterial genome). The plasmid is modified to encode products under control of host-recognized promoters (e.g., eukaryotic promoters, such as RNA polymerase II promoters, including those from eukaryotes, and animal viruses). The plasmids optionally can encode asd to permit replication in vivo, as well as nucleic acids with other beneficial functions (e.g., CpGs) and gene products as described elsewhere herein.

The immunostimulatory bacteria are derived from suitable bacterial strains, including attenuated and wild-type or other non-attenuated strains. Bacterial strains can be attenuated strains, or strains that are attenuated by standard methods, or that, by virtue of the modifications provided herein, are attenuated in that their ability to colonize is limited primarily to immunoprivileged tissues and organs, particularly immune and tumor cells, including solid tumors. Bacteria include, but are not limited to, for example, strains of *Salmonella, Shigella, Listeria, E. coli*, and Bifidobacteriae. For example, species include *Shigella sonnei, Shigella flexneri, Shigella dysenteriae, Listeria monocytogenes, Salmonella typhi, Salmonella typhimurium, Salmonella gallinarum*, and *Salmonella enteritidis*. Other suitable bacterial species include *Rickettsia, Klebsiella, Bordetella, Neisseria, Aeromonas, Francisella, Corynebacterium, Citrobacter, Chlamydia, Haemophilus, Brucella, Mycobacterium, Mycoplasma, Legionella, Rhodococcus, Pseudomonas, Helicobacter, Vibrio, Bacillus*, and *Erysipelothrix*. For example, *Rickettsia rickettsiae, Rickettsia prowazekii, Rickettsia tsutsugamushi, Rickettsia mooseri, Rickettsia sibirica, Bordetella bronchiseptica, Neisseria meningitidis, Neisseria gonorrhoeae, Aeromonas eucrenophila, Aeromonas salmonicida, Francisella tularensis, Corynebacterium pseudotuberculosis, Citrobacter freundii, Chlamydia pneumoniae, Haemophilus somnus, Brucella abortus, Mycobacterium intracellulare, Legionella pneumophila, Rhodococcus equi, Pseudomonas aeruginosa, Helicobacter mustelae, Vibrio cholerae, Bacillus subtilis, Erysipelothrix rhusiopathiae, Yersinia enterocolitica, Rochalimaea quintana*, and *Agrobacterium tumerfacium.*

Exemplary of the immunostimulatory bacteria provided herein are species of *Salmonella*. Exemplary of bacteria for modification as described herein are wild-type strains of *Salmonella*, such as the strain that has all of the identifying characteristics of the strain deposited in the ATCC as accession #14028. Engineered strains of *Salmonella typhimurium*, such as strain YS1646 (ATCC accession no. 202165; also referred to as VNP20009, see, also International PCT Application Publication No. WO 99/13053) that is engineered with plasmids to complement an asd gene knockout and antibiotic-free plasmid maintenance, are provided. The strains then are modified to delete the flagellin genes and/or to delete pagP. The strains also are rendered auxotrophic for purines, particularly adenosine, and are asd$^-$ and msbB$^-$. The asd gene can be provided on a plasmid for replication in the eukaryotic host. These deletions and plasmids are described elsewhere herein. Any of the nucleic acids encoding therapeutic products and immunostimulatory proteins and other products, described elsewhere herein and/or known to those of skill in the art, can be included on the plasmid. The plasmid generally is present in low to medium copy number as described elsewhere herein. Therapeutic products include gain-of-function mutants of cytosolic DNA/RNA sensors, that can constitutively evoke/induce type I IFN expression, and other immunostimulatory proteins, such as cytokines, that promote an anti-tumor immune response in the tumor microenvironment, and other such products described herein.

E. NON-HUMAN STING PROTEINS AND GAIN-OF-FUNCTION MUTATIONS IN PROTEINS THAT STIMULATE THE IMMUNE RESPONSE IN THE TUMOR MICROENVIRONMENT

Provided are immunostimulatory bacteria that contain sequences of nucleotides that encode gene products that are therapeutic, particularly anti-cancer products, including products that promote or stimulate an anti-tumor or anti-viral immune response. Included among the therapeutic products are products, referred to as cytosolic DNA/RNA sensors, that evoke immune responses when exposed to nucleic acids, such as RNA, DNA, nucleotides, dinucleotides, cyclic nucleotides, cyclic dinucleotides, and other such molecules, in the cytosol of cells. The immunostimulatory bacteria herein encode modified products that have increased activity or that constitutively evoke immune responses, and do not require the presence of the DNA/RNA products in the cytosol. Exemplary are encoded proteins that include gain-of-function mutations that increase immune responses in the tumor microenvironment. Not only are immunostimulatory bacteria provided, but also, other delivery vehicles can be used to deliver nucleic acids encoding such immunostimulatory proteins, or to deliver the encoded proteins. These delivery vehicles include exosomes, vectors, and viruses. For example, oncolytic viruses also can be modified to express the gain-of-function products, particularly oncolytic viruses, such as vaccinia virus, that are cytoplasmic viruses. The encoded gain-of-function products can be delivered in exosomes, liposomes, and other suitable vehicles, generally targeted to tumors.

The immunostimulatory bacteria that encode the gain-of-function products (and/or other therapeutic products) include immunostimulatory bacteria that preferentially infect tumors, including tumor-resident immune cells, and/or immunostimulatory bacteria in which the genome is modified so that the bacteria induce less cell death in tumor-resident immune cells, whereby the immunostimulatory bacteria accumulate in tumor cells and tumor-resident immune cells, to thereby deliver the constitutively active proteins and/or other therapeutic products to the cells and the tumor microenvironment, to stimulate the immune response against the tumor. The immunostimulatory bacteria further can encode a tumor antigen in the subject to enhance the response against the particular tumor. Any of the immunostimulatory bacteria provided herein and described above and below can be modified to encode such a gain-of-function product. The product is encoded on a plasmid under control of a promoter, and any other desired regulatory sequences recognized in a eukaryotic, such as a human, or other animal, or mammalian, subject. Generally, the nucleic acid encoding the gain-of-function product is under the control of an RNA polymerase II promoter.

The therapeutic products, including the gain-of-function variants that include STING proteins and other proteins in the type I interferon signaling pathway as described herein, and other anti-cancer products, are expressed under control of a eukaryotic promoter. Promoters include, for example, the EF-1 alpha promoter, CMV, SV40, PGK, EIF4A1, CAG, CD68 and synthetic MND promoters; viral promoters, such as O, MSCV and TLR promoters, and a respiratory syncytial virus (RSV) promoter; cellular promoters, such as EIF-1a; inducible chimeric promoters, such as tet-CMV; and tissue-specific promoters (Chang et al. (2013) *Cold Spring Harb Protoc*; doi:10.1101/pdb.prot075853).

Additionally, any of the bacteria described herein for modification, such as any of the strains of *Salmonella, Shigella, E. coli*, Bifidobacteriae, *Rickettsia, Vibrio, Listeria, Klebsiella, Bordetella, Neisseria, Aeromonas, Francisella, Cholera, Corynebacterium, Citrobacter, Chlamydia, Haemophilus, Brucella, Mycobacterium, Mycoplasma, Legionella, Rhodococcus, Pseudomonas, Helicobacter, Bacillus*, and *Erysipelothrix*, or attenuated strains thereof or modified strains thereof, exosomes, liposomes and oncolytic viruses, can be modified by introducing a plasmid containing, or encoding on a plasmid in the bacteria, nucleic acids encoding the gain-of-function product(s) under control of an RNA polymerase promoter recognized by the host. The gain-of-function products are expressed in the infected subject's cells. The immunostimulatory bacteria include those that are modified, as described herein, to accumulate in, or to preferentially infect, tumors and tumor-resident immune cells. For example, immunostimulatory bacteria that encode gain-of-function products leading to the expression of, or the constitutive expression of, type I interferon (IFN), such as IFN-beta, further are modified to have reduced ability or no ability to infect epithelial cells, but are able to infect phagocytic cells, including tumor-resident immune cells, and/or the bacteria are modified so that they do not kill the infected phagocytic cells.

The immunostimulatory bacteria herein can encode products, referred to as cytosolic DNA/RNA sensors, that evoke immune responses when exposed to nucleic acids, such as RNA, DNA, nucleotides, dinucleotides, cyclic nucleotides, cyclic dinucleotides, and other such molecules, in the cytosol of cells. The immunostimulatory bacteria herein, encode modified products that constitutively evoke immune responses, and do not require the presence of the DNA/RNA and other nucleotides in the cytosol. Exemplary of such are components of pathways that induce type I interferon expression. The products contemplated herein include modified forms of these DNA/RNA sensors, that have constitutive activity or increased activity (gain-of-function products), such that type I interferon(s) is/are expressed or produced in the absence of nucleotides, dinucleotides, cyclic nucleotides, cyclic dinucleotides, and other such ligands, in the cytosol of cells. Expression of these modified products in cells, particularly in tumor cells and tumor-resident immune cells, leads to constitutive expression of type I interferons, including interferon-β, in the tumor microenvironment. Because the immunostimulatory bacteria, and also oncolytic viruses (and other delivery vehicles as described herein), that express these gain-of-function products accumulate in or preferentially infect tumor cells and tumor-resident immune cells, the products are expressed in the tumor microenvironment, resulting in increased immune responses in the tumor microenvironment, and enhanced therapeutic efficacy.

Exemplary gene products that can be encoded in the immunostimulatory bacteria and other vehicles, include, but are not limited to, proteins that sense or are involved in innate pathways that recognize cytosolic DNA/RNA and activate type I interferon production. Proteins involved in innate DNA/RNA recognition that activate type I interferon include, but are not limited to: STING, RIG-I, MDA-5, IRF-3, IRF-7, TRIM56, RIP1/RIPK1, Sec5/EXOC2, TRAF2, TRAF3, TRAF6, STAT1, LGP2/DHX58, DDX3/DDX3X, DHX9/DDX9, DDX1, DDX21, DHX15/DDX15, DHX33/DDX33, DHX36/DDX36, DDX60, and SNRNP200. Gain-of-function mutations in any of these proteins that result in constitutive type I interferon expression are known, or can be identified, and can be delivered by the immunostimulatory bacteria, or other vectors, and delivery vehicles, such as exosomes or liposomes, to the tumor microenvironment, such as by infection of cells or targeting and binding to tumor cells. The gain-of-function mutations include those identified from individuals with disorders resulting from constitutive type I interferon expression. Exemplary of gain-of-function products are those that occur in subjects with interferonopathies. As noted above, mutations can be identified by screening to generate gain-of-function products as well.

The immunostimulatory bacteria herein encode such proteins, such as STING, including non-human STING proteins that have lower NF-κB signaling activity than the NF-κB signaling activity of human STING, and variants of the STING proteins and other DNA/RNA sensors that constitutively evoke immune responses, and do not require the presence of the DNA/RNA or other nucleotide ligands in the cytosol. Exemplary of such are components of pathways that induce type I interferon expression.

The nucleic acids encoding the identified gain-of-function mutant products can be further modified to improve properties for expression. Modifications include, for example, codon optimization to increase transcriptional efficiency in a mammalian, particularly human, subject, such as reduction of GC content or CpG dinucleotide content, removal of cryptic splicing sites, negative CpG islands, replacement of the Shine-Dalgarno (SD) sequence, and replacement of TATA box and/or terminal signals to increase transcriptional efficiency. Also, codons can be optimized for increasing translation efficiency by altering codon usage bias, decreasing GC content, decreasing mRNA secondary structure, removing premature PolyA sites, removing RNA instability motifs (ARE), reducing stable free energy of mRNA, modifying internal chi sites and ribosomal binding sites, and reducing RNA secondary structures.

1. Type I Interferons and Pathways

Type I interferon induction pathways, mediated by host recognition of nucleic acids, such as single-stranded and double-stranded RNA, and of cyclic di-nucleotides and other such forms of nucleic acids, are known to induce type I IFN. There also are Toll-Like Receptor (TLR)-independent type I IFN pathways, mediated by host recognition of single-stranded (ss) and double-stranded (ds) RNA in the cytosol. These nucleic acids are sensed by RNA helicases, including retinoic acid-inducible gene I (RIG-I), melanoma differentiation-associated gene 5 (MDA-5), and through IFN-β promoter stimulator 1 (IPS-1) adaptor protein-mediated phosphorylation of the IRF-3 transcription factor, leading to induction of IFN-beta (Ireton and Gale (2011) *Viruses* 3(6):906-919). As discussed herein, proteins in these pathways can be modified, or can exist as variants, that result in constitutive expression of type I interferons (also referred to as interferon type 1), which include IFN-α and IFN-β. Provided herein are immunostimulatory bacteria and other delivery vehicles, including exosomes, liposomes and oncolytic viruses, that encode the variant proteins. These delivery vehicles can be used to treat cancers by directly administering to subjects and/or by administering them to cells, allogeneic or autologous, for use in cell therapy protocols.

Type I interferons (IFNs; also referred to as interferon type 1), include IFN-α and IFN-β, and are pleiotropic cytokines with antiviral, antitumor and immunoregulatory activities. IFN-β is produced by most cell types; IFN-α primarily is produced by hematopoietic cells, particularly plasmacytoid dendritic cells. Type I IFNs are produced following the sensing of pathogen-associated molecular patterns (PAMPs), including microbial and viral nucleic acids and LPS (lipopolysaccharides), by pattern recognition receptors (PRRs) and by cytokines. They are involved in the innate immune response against pathogenic, including viral, infection, and are potent immunomodulators that promote antigen presentation, mediate DC maturation, activate cytotoxic T lymphocytes (CTLs), natural killer (NK) cells and macrophages, and activate the adaptive immune system by promoting the development of high-affinity antigen-specific T and B cell responses and immunological memory.

Type I IFNs exhibit anti-proliferative and pro-apoptotic effects on tumors and have anti-angiogenic effects on tumor neovasculature. They induce the expression of MHC class I molecules on tumor cell surfaces, increase the immunogenicity of tumor cells, and activate cytotoxicity against them. Type I IFN has been used as a therapeutic for treatment of cancers and viral infections. For example, IFN-α (sold under the trademark Intron-A®/Roferon-A®) is approved for the treatment of hairy cell leukemia, malignant melanoma, AIDS-related Kaposi's sarcoma, and follicular non-Hodgkin's lymphoma; it also is used in the treatment of chronic myelogenous leukemia (CML), renal cell carcinoma, neuroendocrine tumors, multiple myeloma, non-follicular non-Hodgkin's lymphoma, desmoid tumors and cutaneous T-cell lymphoma (Ivashkiv and Donlin (2014) *Nat. Rev. Immunol.* 14 (1): 36-49; Kalliolias and Ivashkiv (2010) *Arthritis Research & Therapy* 12 (Suppl 1): S1; Lee, S. and Margolin, K. (2011) *Cancers* 3:3856-3893).

Expression of type I interferons in tumors and the tumor microenvironment is among the immune responses that the immunostimulatory bacteria and other delivery vehicles herein are designed to evoke. Inducing or evoking type I interferon provides anti-tumor immunity for the treatment of cancer.

2. Type I Interferonopathies and Gain-of-Function Mutants

The induction of type I interferons (IFNs), proinflammatory cytokines and chemokines is necessary for mounting an immune response that prevents or inhibits infection by pathogens. This response also can be effective as an anti-tumor agent. The immunostimulatory bacteria and other delivery vehicles provided herein encode proteins that constitutively induce type I IFNs. Among these proteins are those that occur in individuals with various diseases or disorders that involve the over-production of immune response modulators. For example, over-production or excessive production, or defective negative regulation of type I IFNs and pro-inflammatory cytokines, can lead to undesirable effects, such as inflammatory and autoimmune diseases. Disorders involving the overproduction, generally chronic, of type I IFNs and pro-inflammatory cytokines, are referred to as interferonopathies (see, e.g., Lu and MacDougall (2017) *Front. Genet.* 8:118; and Konno et al. (2018) *Cell Reports* 23:1112-1123). Disorders and clinical phenotypes associated with type I interferonopathies include Aicardi-Goutiéres syndrome (AGS), STING-associated vasculopathy with onset in infancy (SAVI), Singleton-Merten syndrome (SMS), atypical SMS, familial chilblain lupus (FCL), systemic lupus erythematosus (SLE), bilateral striatal necrosis (BSN), cerebrovascular disease (CVD), dyschromatosis symmetrica hereditaria (DSH), spastic paraparesis (SP), X-linked reticulate pigmentary disorder (XLPDR), proteasome-associated auto-inflammatory syndrome (PRAAS), intracranial calcification (ICC), Mendelian susceptibility to mycobacterial disease (MSMD), and spondyloenchondrodysplasia (SPENCD) (see, e.g., Rodero et al. (2016) *J. Exp. Med.* 213(12):2527-2538). These phenotypes are associated with particular genotypes, involving mutations in genes that lead to constitutive activities of products involved in the induction of type I IFNs.

The sustained activation of interferon signaling can be due to: 1) loss-of-function mutations leading to increased cytosolic DNA (e.g., mutations in TREX1 and SAMHD1) or increased cytosolic RNA/DNA hybrids (e.g., mutations in RNASEH2A, RNASEH2B, RNASEH2C and POLA1); 2) loss-of-function mutations resulting in a defect in RNA editing and abnormal sensing of self-nucleic acid RNA species in the cytosol (e.g., mutations in ADAR1); 3) gain-of-function mutations leading to constitutive activation of cytosolic IFN signaling pathways/increased sensitivity to cytosolic nucleic acid ligands (e.g., mutations in RIG-I, MDA5 and STING); 4) loss-of-function mutations leading to aberrant RNA signaling via MAVS caused by a disturbance of the unfolded protein response (e.g., mutations in SKIV2L); 5) loss-of-function mutations in molecules responsible for limiting IFN receptor (IFNAR1/2) signaling, leading to uncontrolled IFN-stimulated gene (ISG) production (e.g., mutations in USP18 and ISG15); 6) proteasomal dysfunction, leading to increased IFN signaling through an unknown mechanism (e.g., mutations in PSMA3, PSMB4 and PSMB8); and 7) loss-of-function mutations in TRAP/ACP5 and C1q, where the mechanisms leading to type I IFN signaling remain unclear (Rodero et al. (2016) *J. Exp. Med.* 213(12):2527-2538).

Of interest herein are mutations that lead to gain-of-function. There are known mutations in STING, MDA5 and RIG-I, associated with gain-of-function (GOF), resulting in the constitutive activation of the encoded proteins and/or enhanced sensitivity or increased affinity or binding to endogenous ligands. GOF mutations in STING, for example, are linked to SAVI and FCL; GOF mutations in MDA5 are linked to AGS and SMS; and GOF mutations in RIG-I are linked to atypical SMS.

The immunostimulatory bacteria, and oncolytic viruses, provided herein that encode these proteins with gain-of-function mutations, exploit the constitutive activation of these proteins to increase production of type I IFNs and pro-inflammatory cytokines. Tumor-targeting immunostimulatory bacteria, as well as oncolytic viruses and other delivery vehicles, are provided herein that encode STING, MDA5 and/or RIG-I with gain-of-function mutations. Such immunostimulatory bacteria and other delivery vehicles, increase the production of type I IFNs and pro-inflammatory cytokines in the tumor microenvironment, potentiating the anti-tumor immune response and improving the therapeutic efficacy of the immunostimulatory bacteria. The gene encoding STING is referred to as TMEM173, the gene encoding MDA5 is IFIH1, and the gene encoding RIG-I is DDX58. There are numerous alleles for each gene, and known mutations that can occur in genes with any of the alleles, resulting in gain-of-function. The mutations listed below can occur singly or can be used in any combination. Other mutations that result in gain-of-function can be identified by routine screening/mutation protocols. The table below lists exemplary gain-of-function mutations in each of STING/TMEM173 (SEQ ID NOs: 305-309), MDA5/IFIH1 (SEQ ID NO: 310) and RIG-I/DDX58 (SEQ ID NO: 311). Other mutations, such as deletion of, or replacement of, a phosphorylation site or sites, such as 324-326 SLS→ALA in STING, and other replacements to eliminate a phosphorylation site to reduce nuclear factor-κB (NF-κB) signaling in STING, or other proteins that employ such signaling, also can be introduced.

The resulting proteins can be encoded in the immunostimulatory bacteria provided herein. The proteins are encoded on plasmids in the immunostimulatory bacteria or, can be encoded on the genome of an oncolytic virus, or delivered via a delivery vehicle, such as an exosome or liposome.

Table of Gain-Of-Function Mutants

| Exemplary normal function proteins in which the mutations are introduced | Gain-of-function mutations |
|---|---|
| STING/TMEM173 (SEQ ID NOs: 305-309) | S102P |
| | V147L |
| | V147M |
| | N154S |
| | V155M |
| | G166E |
| | C206Y |
| | G207E |
| | S102P/F279L |
| | F279L |
| | R281Q |
| | R284G |
| | R284S |
| | R284M |
| | R284K |
| | R284T |
| | R197A |
| | D205A |
| | R310A |
| | R293A |
| | T294A |
| | E296A |
| | R197A/D205A |
| | S272A/Q273A |
| | R310A/E316A |
| | E316A |
| | E316N |
| | E316Q |
| | S272A |
| | R293A/T294A/E296A |
| | D231A |
| | R232A |
| | K236A |
| | Q273A |
| | S358A/E360A/S366A |
| | D231A/R232A/K236A/R238A |
| | S358A |
| | E360A |
| | S366A |
| | R238A |
| | R375A |
| | S324A/S326A |
| MDA5/IFIH1 (SEQ ID NO: 310) | T331I |
| | T331R |
| | A489T |
| | R822Q |
| | G821S |
| | A946T |
| | R337G |
| | D393V |
| | G495R |
| | R720Q |
| | R779H |
| | R779C |
| | L372F |
| | A452T |
| RIG-I (SEQ ID NO: 311) | E373A |
| | C268F |

Amino acid residues R197, D205, R310, R293, T294, E296, S272, Q273, E316, D231, R232, K236, S358, E360, S366, and R238, with reference to the sequence of human STING, as set forth in SEQ ID NOs:305-309, correspond to amino acid residues R196, D204, R309, R292, T293, E295, S271, Q272, E315, D230, R231, K235, S357, E359, S365 and R237, respectively, with reference to the sequence of murine STING, as set forth in SEQ ID NO:351.

3. STING-Mediated Immune Activation

STING (stimulator of interferon genes), also known as transmembrane protein 173 (TMEM173), mediator of IRF3 activation (MITA), methionine-proline-tyrosine-serine (MPYS), and endoplasmic reticulum (ER) IFN stimulator (EMS), is a 379 amino acid protein that occurs in the endoplasmic reticulum, and that functions as a signaling adaptor protein, controlling the transcription of immune response genes, such as type I IFNs and pro-inflammatory cytokines. Stimulation of the STING pathway activates endothelial cells and induces the up-regulation of interferon-response genes, apoptosis pathway genes, and endothelial cell death in culture and tissue-factor expression, which is a potent initiator of the coagulation cascade (Liu et al. (2014) *N. Engl. J. Med.* 371:507-518).

Due to its role in promoting IFN production and inflammation, human STING is an immunotherapeutic target for cancers and infectious diseases. For example, studies have shown that direct activation of STING by its ligand cyclic dinucleotides (CDNs) can induce tumor death. As a result, tumors with increased STING expression can be killed directly by the activation of the STING-mediated cell death pathway. Activation of the STING pathway in dendritic cells (DCs) promotes DC maturation, which initiates $CD8^+$ T cell-mediated cytotoxic responses and generates a memory response to prevent cancer relapse. STING also can enhance the therapeutic efficacy of radiotherapy and chemotherapy, due to the released DNA that results from these treatments. In mice, the efficacy of the Pneumovax23® vaccine depends on STING, as the vaccine is ineffective in a mouse model of the human HAQ loss-of-function allele. CDNs lose their adjuvant activity in the HAQ mice, demonstrating the role of STING in infection.

STING signaling boosts host immune recognition of tumor antigens and leads to potent antitumor responses. Studies have shown that STING expression and signaling are suppressed in many cancers, including colorectal carcinoma, and this loss of STING signaling hinders DNA damage responses and anti-tumor T cell priming. STING expression also is lost/deregulated in many primary and metastatic melanomas and in Burkett's lymphoma, breast cancer, leukemia, lymphoma, $HPV^+$ cancers, HCV- or HBV-related hepatocellular carcinoma, and herpes virus associated cancer. Reconstitution of STING into cancer cells lines, such as 293T and MCF7, which are defective in intracellular DNA signaling, rescues the intracellular pathway, and can induce type I IFN and other signal transduction pathways (see, e.g., U.S. Patent Application Publication No. 2018/0085432). As a result, STING agonists are being developed for cancer immunotherapy. U.S. Patent Application Publication No. 2018/0085432 describes the use of nucleic acid sequences encoding wild-type STING, for the modulation of the immune system to treat diseases, such as those caused by foreign agents, such as infections by bacteria, fungi, parasites and viruses, and also to induce an anti-tumor response. The STING can be administered to patients for treatment of cancer as a polynucleotide, polypeptide, peptide, antisense oligonucleotide, in vectors expressing STING, antibodies and the like. Vectors include viral vectors (adenoviruses, adeno-associated viruses, VSV and retroviruses), liposomes, other lipid-containing complexes, and other macromolecular complexes capable of mediating delivery of a polynucleotide to a host cell (U.S. Publication No. 2018/0085432). U.S. Publication No. 2018/0311343 describes administration of mRNA encoding a constitutively active human STING polypeptide with mRNA encoding an antigen of interest, such as a tumor, viral or bacterial antigen, in order to lead to an immune response against the antigen.

STING plays an important role in innate immunity as a cytosolic DNA/RNA sensor. STING, by virtue of its interaction with a product from cytosolic dsDNA, "senses" cytosolic dsDNA from infectious pathogens or aberrant host cell damage. Sensing of cytosolic dsDNA through STING requires cyclic GMP-AMP synthase (cGAS), a host cell nucleotidyl transferase that directly binds to dsDNA, and in response, synthesizes a cyclic dinucleotide (CDN) second messenger, cyclic GMP-AMP (cGAMP), which binds to and activates STING (see, e.g., Barber (2011) *Immunol. Rev.* 243(1):99-108; Sun et al. (2013) *Science* 339(6121):786-791; and Wu et al. (2013) *Science* 339(6121):826-830). STING also is activated by CDNs synthesized by bacteria in the cytosol, including cyclic di-GMP and cyclic di-AMP. STING dimerizes after binding to CDNs and activates TANK binding kinase (TBK1), which then phosphorylates IRF-3 and NF-κB transcription factors. Activation of the IRF3-, IRF7- and NF-κB-dependent signaling pathways induces the production of IFN-β and other pro-inflammatory cytokines, such as TNF-α, IL-12p40 and IFN-γ, that strongly activate innate and adaptive immunity (Burdette et al. (2011) *Nature* 478(7370):515-518). Aberrant or variant STING, which acts constitutively without binding to CDNs, occurs in subjects with interferonopathies. It thereby can constitutively induce production of type I IFNs. STING is encoded by TMEM173.

4. TMEM173 Alleles

Stimulator of interferon genes (STING) is encoded by the transmembrane protein 173 (TMEM173) gene, which is a ~7 kb-long gene. The human TMEM73 gene is characterized by significant heterogeneity and population stratification of alleles. The most common human TMEM173 allele is referred to as R232 (referencing the amino acid present at residue 232; see SEQ ID NOs: 305-309, setting forth the sequences of various human TMEM173 alleles). More than half the American population is not R232/R232. The second most common allele is R71H-G230A-R293Q (HAQ). Other common alleles include AQ (G230A-R293Q), Q293 and H232. HAQ/HAQ cells were found to express STING protein to an extremely low degree, and had decreased levels of TMEM173 transcripts in comparison to R232/R232 cells. R232/R232 is the most common genotype in Europeans, while HAQ/R232 is the most common genotype in East Asians. Africans have no HAQ/HAQ genotypes, but have the Q293 allele, and ~4% of Africans are AQ/AQ, which is absent in other ethnic populations. HAQ and H232 are likely loss-of-function alleles, and ~30% of East Asians and ~10% of Europeans are HAQ/HAQ, HAQ/H232, or H232/H232 (Patel and Jin (2018) *Genes & Immunity*, doi:10.1038/s41435-018-0029-9).

5. Constitutive STING Expression and Gain-of-Function Mutations

Several activating or gain-of-function (GOF) mutations in TMEM173, inherited and de novo, have been linked to a rare auto-inflammatory disease known as SAVI (STING-associated vasculopathy with onset in infancy). SAVI is an autosomal dominant disease and is characterized by systemic inflammation, interstitial lung disease, cutaneous vasculitis, and recurrent bacterial infection. SAVI with de novo TMEM173 mutations typically is characterized by an early-onset (<8 weeks) and severe phenotype, while familial mutations result in late-onset (teens to adults) and milder clinical symptoms. Inherited TMEM173 activating mutations include G166E and V155M, whereas de novo mutations include N154S, V155M, V147M, V147L, C206Y, R284G, R281Q and S102P/F279L (Patel and Jin (2018) *Genes & Immunity*, doi:10.1038/s41435-018-0029-9). Other activating TMEM173 mutations that have been identified include R284M, R284K, R284T and R375A (U.S. Pat. Publication No. 2018/0311343). Another gain-of-function mutation in TMEM173 is R284S, which results in a highly constitutively active STING and was found to trigger innate immune signaling in the absence of activating CDNs, leading to chronic production of pro-inflammatory cytokines (Konno et al. (2018) *Cell Reports* 23:1112-1123).

TMEM173 mutations, such as N154S, V155M and V147L, and/or any of the mutations listed in the table above, singly or in any combination, result in a gain-of-function STING that is constitutively active and hypersensitive to ligand stimulation, leading to chronic activation of the STING-interferon pathway. This has been demonstrated (Liu et al. (2014) *N. Engl. J. Med.* 371:507-518). Constructs of mutated TMEM173 (with each of the replacements V147L, N154S, V155M and loss-of-function mutant V155R) and non-mutated TMEM173 were transfected into STING-negative HEK293T cells, and stimulated with the STING ligand, cGAMP. Cells transfected with the N154S, V155M and V147L mutants exhibited highly elevated IFNB1 (the gene encoding IFN-β) reporter activity, which was not significantly boosted by stimulation with the STING ligand cGAMP. Cells that were transfected with the loss-of-function mutant (V155R), non-mutated TMEM173, or control plasmid, had no significant baseline activation. Stimulation with cGAMP resulted in a response in a dose-dependent manner in cells with non-mutated TMEM173, and resulted in a minimal response only at the highest cGAMP concentration, in cells expressing the loss-of-function mutant (Liu et al. (2014) *N. Engl. J. Med.* 371:507-518). These results show that the activating TMEM173 mutations result in constitutive activation of STING, even in the absence of stimulation by cGAMP.

G207E is another gain-of-function STING mutation that causes alopecia, photosensitivity, thyroid dysfunction, and SAVI-features. The G207E mutation causes constitutive activation of inflammation-related pathways in HEK cells, as well as aberrant interferon signature and inflammasome activation in patient peripheral blood mononuclear cells (PBMCs). Using STING variants with the R232 or H232 allele and the GOF mutation G207E, it was shown that after stimulation with CDN, the R232+G207E variant resulted in slight increases of activity in the IFN-β and STAT1/2 pathways, while with the H232+G207E variant, IFN-β levels remained constant, and STAT1/2 showed diminished activity. Both variants showed similar STAT3 and NF-κB pathway activation following stimulation. These results show that R at position 232 is important for cGAMP binding and IFN induction, and show that G207E mutants result in constitutive activation of STING signaling pathways and ligand-dependent hyperactivation of the NF-κB pathway. Patients with the R232 allele and G207E had more severe disease; this polymorphism strengthens the constitutive activation of the mutant STING, leading to the overexpression of downstream targets such as IFN, IL1β and IL-18 (see, e.g., Keskitalo et al. (2018) available from: doi.org/10.1101/394353).

67 amino acids in murine STING (see, e.g., SEQ ID NO:351) were mutated (Burdette et al. (2011) *Nature* 478 (7370):515-518) either individually or in groups, to identify amino acids involved in cyclic di-GMP (c-di-GMP) binding and/or IFN induction. Among the mutants identified were hyperactive mutants R196A/D204A, S271A/Q272A, R309A/E315A, E315A, E315N, E315Q and S271A (corresponding to R197A/D205A, S272A/Q273A, R310A/E316A, E316A, E316N, E316Q and S272A, respectively, with reference to the sequence of human STING as set forth in SEQ ID NOs:305-309), that spontaneously induced IFN at low levels of transfection and did not respond to c-di-GMP, and the mutants R374A, R292A/T293A/E295A/E299A, D230A, R231A, K235A, Q272A, S357A/E359A/

S365A, D230A/R231A/K235A/R237A and R237A (corresponding to R375A, R293A/T294A/E296A (there is no equivalent to E299A in human STING), D231A, R232A, K236A, Q273A, S358A/E360A/S366A, D231A/R232A/K236A/R238A and R238A, respectively, with reference to human STING, as set forth in SEQ ID NOs:305-309), that induced IFN when overexpressed but did not respond to c-di-GMP.

Administering nucleic acids encoding wild-type STING can induce an immune response; the administration of gain-of-function STING mutants, with constitutive activity as provided herein, in tumor-targeted delivery vehicles, leads to a more potent immune response and more effective anti-cancer therapeutic. The enhanced immune response by the tumor-targeted administration of constitutively active STING or other such modified DNA/RNA sensors, such as gain-of-function mutants of MDA5 or RIG-I, as provided herein, provides a therapeutically more effective anti-cancer treatment. For example, as described herein, modifying the immunostimulatory bacteria so that they do not infect epithelial cells, but retain the ability to infect phagocytic cells, including tumor-resident immune cells, effectively targets the immunostimulatory bacteria to the tumor microenvironment, improving therapeutic efficiency and preventing undesirable systemic immune responses. These tumor-targeted bacteria are engineered to encode gain-of-function STING, MDA5 or RIG-I mutants, which are constitutively active, for example, even in the absence of ligand stimulation, providing a potent type I IFN response to improve the anti-cancer immune response in the tumor microenvironment.

Thus, for example, the administration of constitutively activated STING can provide an alternative means to boost STING signaling for the immunotherapeutic treatment of cancer. In certain embodiments, the tumor-targeting immunostimulatory bacteria provided herein, and also oncolytic viruses, can be modified to encode STING/TMEM731 (SEQ ID NOs: 305-309) with gain-of-function mutations selected from S102P, V147L, V147M, N154S, V155M, G166E, R197A, D205A, R197A/D205A, C206Y, G207E, D231A, R232A, K236A, R238A, D231A/R232A/K236A/R238A, S272A, Q273A, S272A/Q273A, F279L, S102P/F279L, R281Q, R284G, R284S, R284M, R284K, R284T, R293A, T294A, E296A, R293A/T294A/E296A, R310A, E316A, E316N, E316Q, R310A/E316A, S324A/S326A, S358A, E360A, S366A, S358A/E360A/S366A, and R375A.

6. Non-Human STING Proteins, and Variants Thereof with Increased or Constitutive Activity, and STING Chimeras, and Variants Thereof with Increased or Constitutive Activity As discussed above, cytosolic double-stranded DNA (dsDNA) stimulates the production of type I interferon (IFN) through the endoplasmic reticulum (ER)-resident adaptor protein STING (stimulator of IFN genes), which activates the transcription factor interferon regulatory factor 3 (IRF3). The TANK binding kinase (TBK1)/IRF3 axis results in the induction of type I IFNs, and the activation of dendritic cells (DCs) and cross-presentation of tumor antigens to activate $CD8^+$ T cell-mediated anti-tumor immunity. STING signaling also activates the nuclear factor kappa-light-chain-enhancer of activated B cell (NF-κB) signaling axis, resulting in a pro-inflammatory response, but not in the activation of the DCs and $CD8^+$ T cells that are required for anti-tumor immunity.

Upon recognition of 2'3' cGAMP, STING translocates from the endoplasmic reticulum through the Golgi apparatus, allowing the recruitment of TANK-binding kinase 1 (TBK1) and activation of the transcription factors IRF3 and NF-κB. The carboxyl-terminal tail (C-terminal tail or CTT) region of STING is necessary and sufficient to activate TBK1 and stimulate the phosphorylation of IRF3; it also is involved in NF-κB signaling. The CTT is an unstructured stretch of approximately 40 amino acids that contains sequence motifs required for STING phosphorylation and recruitment of IRF3. IRF3 and NF-κB downstream signaling is attributed to the specific sequence motifs within the C-terminal tail (CTT) of STING that are conserved among vertebrate species. Modular motifs in the CTT, which include IRF3, TBK1 and TRAF6 binding modules, control the strength and specificity of cell signaling and immune responses.

Depending on the species and the respective characteristics of their STING CTT discrete elements, the IRF-3 and NF-κB downstream responses can be affected and sometimes opposite. The STING CTT elements dictate and finely tune the balance between the two signaling pathways, resulting in different biological responses. In human and mouse immune cells, for example, STING-dependent IRF-3 activation results predominantly in a type I interferon response. STING signaling in human cells also drives a pro-inflammatory response through canonical and possibly non-canonical NF-κB pathways via TRAF6 recruitment. Human STING residue S366 (see, e.g., SEQ ID NOs:305-309) is a primary TBK1 phosphorylation site that is part of an LxIS motif in the CTT, which is required for IRF3 binding, while a second PxPLR motif, including residue L374, is required for TBK1 binding. The LxIS and PxPLR motifs are highly conserved in all vertebrate STING alleles. In other species, STING signaling results predominantly in the activation of the NF-κB signaling axis. For example, the zebrafish CTT, which is responsible for hyperactivation of NF-κB signaling, contains an extension with a highly conserved PxExxD motif at the extreme C-terminus that is not present in human and mammalian STING alleles; this motif shares similarity with tumor necrosis factor receptor-associated factor 6 (TRAF6) binding sites. While the role of TRAF6 in human STING signaling is non-essential, TRAF6 recruitment is essential for zebrafish STING-induced NF-κB activation. A human-zebrafish STING chimera, in which human STING was engineered to contain the zebrafish STING CTT module DPVETTDY, induced more than 100-fold activation of NF-κB activation, indicating that this region is necessary and sufficient to direct enhanced NF-κB signal activation. The addition of the zebrafish CTT also resulted in an increased STING interferon response (see, de Oliveira Mann et al. (2019) *Cell Reports* 27:1165-1175).

The differences among species in the balance between IRF3 and NF-κB signaling is exploited herein to produce modified STING proteins that have reduced NF-κB signaling, and/or optionally, increased IRF3 signaling, so that when the STING protein is delivered to and expressed in the TME, the resulting response is an increased anti-tumor/anti-viral response, compared to the unmodified STING protein.

In some embodiments, STING proteins from species that have low or no NF-κB signaling activity are provided in delivery vehicles, including any of the immunostimulatory bacteria described herein or known to those of skill in the art, as well as in other delivery vehicles, such as viral vectors, including oncolytic vectors, minicells, exosomes, liposomes, and in cells, such as T-cells used in cell therapy and used to deliver vehicles, such as bacteria and oncolytic vectors.

The non-human STING proteins can be, but are not limited to, STING proteins from the following species: Tasmanian devil (*Sarcophilus harrisii*; SEQ ID NO:331), marmoset (*Callithrix jacchus*; SEQ ID NO:341), cattle (*Bos*

*taurus*; SEQ ID NO:342), cat (*Felis catus*; SEQ ID NO:338), ostrich (*Struthio camelus australis*; SEQ ID NO:343), crested ibis (*Nipponia nippon*; SEQ ID NO:344), coelacanth (*Latimeria chalumnae*; SEQ ID NOs:345-346), boar (*Sus scrofa*; SEQ ID NO:347), bat (*Rousettus aegyptiacus*; SEQ ID NO:348), manatee (*Trichechus manatus latirostris*; SEQ ID NO:349), ghost shark (*Callorhinchus milii*; SEQ ID NO:350), and mouse (*Mus musculus*; SEQ ID NO:351). These vertebrate STING proteins readily activate immune signaling in human cells, indicating that the molecular mechanism of STING signaling is shared amongst vertebrates (see, de Oliveira Mann et al. (2019) *Cell Reports* 27:1165-1175).

In other embodiments, the non-human STING proteins contain any of the constitutive STING expression and gain-of-function mutations in corresponding loci in the non-human STING (see, FIGS. 1-13, which provide exemplary alignments, and Example 28, which provides corresponding mutations in various species) to those in human STING, described in section 5 above.

In other embodiments, chimeras of STING proteins are provided. In the chimeras, the CTT region, or portion thereof that confers or participates in NF-κB signaling/activity, of a first species STING protein is replaced with the corresponding CTT or portion(s) thereof from a second species, whose STING protein has lower or very little, less than human, NF-κB signaling activity. The CTT from the second species also, or alternatively, has increased type I IFN signaling. Generally, the first species is human, and the CTT or portion(s) thereof is from the STING of a species such as Tasmanian devil, marmoset, cattle, cat, ostrich, boar, bat, manatee, crested ibis, coelacanth, and ghost shark, which have much lower NF-κB activity. This thereby results in a STING protein that induces type I interferon, which is important for anti-tumor activity, and that has limited or no NF-κB activity, which is not desirable in an anti-tumor therapy. The chimeras can further include the constitutive STING expression and gain-of-function mutations in corresponding loci to increase or render type I interferon activity constitutive. In all embodiments, the TRAF6 binding motif can be deleted to further decrease or eliminate activity that is not desirable in an anti-tumor therapeutic.

These non-human STING proteins, chimeras, and mutants are provided in delivery vehicles, such as any described herein or known to those of skill in the art, including oncolytic viral vectors, cells, such as stem cells and T-cells used in cell therapies, exosomes, minicells, liposomes, and the immunostimulatory bacteria provided herein, which accumulate in tumor-resident immune cells, and deliver encoded proteins to the tumor microenvironment and tumors. The non-human STING proteins, modified STING proteins and chimeras are for use as therapeutics for the treatment of tumors as described herein or in other methods known to those of skill in the art. Pharmaceutical compositions containing the STING proteins, delivery vehicles, and encoding nucleic acids also are provided.

7. Other Gene Products that Act as Cytosolic DNA/RNA Sensors and Constitutive Variants a. Retinoic Acid-Inducible Gene I (RIG-I)-Like Receptors (RLRs)

Other gene products that sense or interact with cytosolic nucleic acids are the retinoic acid-inducible gene I (RIG-I)-like receptors (RLRs), which include RIG-I and MDA5 (melanoma differentiation-associated protein 5). RLRs are cytoplasmic sensors of viral dsRNA and nucleic acids secreted by bacteria, and include RIG-I, MDA5 and LGP2 (laboratory of genetics and physiology 2). Upon the binding of a ligand, such as a viral dsRNA, RIG-I and MDA5 activate the mitochondrial antiviral-signaling adaptor protein, or MAVS, which recruits tumor necrosis factor (TNF) receptor-associated factors (TRAFs), to assemble a signaling complex at the outer membranes of the mitochondria. Downstream signaling components further are recruited by TRAFs, resulting in the phosphorylation and activation of IRF-3 (interferon regulatory factor 3), IRF-7, NF-κB (nuclear factor kappa-light-chain-enhancer of activated B cells), and AP-1 (activator protein 1). As a result, the expression of IFNs, proinflammatory cytokines and other genes involved in pathogen clearance, is induced (see, e.g., Lu and MacDougall (2017) *Front. Genet.* 8:118).

Like STING, the constitutive activation of MDA5 and RIG-I due to gain-of-function mutations leads to the induction of type I IFNs, which can be leveraged to enhance the anti-tumor immune response in immunostimulatory bacteria and oncolytic viruses.

b. MDA5/IFIH1

Another interferonopathy gene is the IFN-induced with helicase C domain-containing protein 1 (IFIH1), also known as melanoma differentiation-associated protein 5 (MDA5), which is a member of the RIG-I-like family of cytoplasmic DExD/H box RNA receptors. MDA5, encoded by IFIH1, is a 1025 amino acid cytoplasmic pattern-recognition receptor that senses viral double-stranded RNA (dsRNA) and secreted bacterial nucleic acids in the cytoplasm, and activates type I IFN signaling through an adaptor molecule, MAVS (mitochondrial antiviral signaling protein). MAVS recruits tumor necrosis factor (TNF) receptor-associated factors (TRAFs), which in turn recruit downstream signaling components, resulting in the phosphorylation and activation of IRF-3 (interferon regulatory factor 3), IRF-7, NF-κB (nuclear factor kappa-light-chain-enhancer of activated B cells), and AP-1 (activator protein 1). This results in the expression of IFNs, proinflammatory cytokines and other genes involved in pathogen clearance (Rutsch et al. (2015) *Am. J. Hum. Genet.* 96:275-282; Rice et al. (2014) *Nat. Genet.* 46(5):503-509; Lu and MacDougall (2017) *Front. Genet.* 8:118).

Gain-of-function (GOF) IFIH1 variants occur in subjects with autoimmune disorders, including Aicardi-Goutiéres syndrome (AGS) and Singleton-Merten syndrome (SMS), which are characterized by prominent vascular inflammation. AGS is an inflammatory disease particularly affecting the brain and skin, and is characterized by an upregulation of interferon-induced transcripts. AGS typically occurs due to mutations in any of the genes encoding DNA exonuclease TREX1, the three non-allelic components of the RNase H2 endonuclease complex, the deoxynucleoside triphosphate triphosphohydrolase SAMHD1, and the double-stranded RNA editing enzyme ADAR1. Some patients with AGS do not have mutations in any of these six genes, but have GOF mutations in IFIH1, indicating that this gene also is implicated in AGS. Singleton-Merten syndrome (SMS) is an autosomal-dominant disorder characterized by abnormalities in the blood vessels (e.g., calcification), teeth (e.g., early-onset periodontitis, root resorption) and bones (e.g., osteopenia, acro-osteolysis, osteoporosis). Interferon signature genes are upregulated in SMS patients, which was linked to GOF mutations in IFIH1 (Rice et al. (2014) *Nat. Genet.* 46(5):503-509; Rutsch et al. (2015) *Am. J. Hum. Genet.* 96:275-282).

The IFN-β reporter stimulatory activity of wild-type IFIH1 and six IFIH1 GOF mutants identified in AGS patients (R720Q, R779H, R337G, R779C, G495R, D393V) was compared in HEK293T cells, which express low levels of endogenous viral RNA receptors. Wild-type IFIH1 was induced upon binding of the long (>1 kb) dsRNA analog polyinosinic-polycytidylic acid (polyI:C), but not by a short 162 bp dsRNA, and had minimal activity in the absence of exogenous RNA. The IFIH1 mutants displayed a significant induction of IFN signaling in response to the short 162 bp dsRNA, in addition to robust signaling in response to polyI:C. The mutants also displayed a 4-10 fold higher level of baseline signaling activity in the absence of exogenous ligand (Rice et al. (2014) *Nat. Genet.* 46(5):503-509).

Another gain-of-function IFIH1 mutation, R822Q, was identified as causing SMS by triggering type I IFN production, and leading to early arterial calcification, as well as dental inflammation and resorption. HEK293T cells (which have the lowest endogenous IFIH1 expression levels) were used to overexpress wild-type and R822Q MDA5. Wild-type IFIH1 expression led to an increase in the expression of IFNB1 (interferon, beta 1, fibroblast) in a dose-dependent manner, whereas the mutated IFIH1 led to approximately 20-fold more IFNB1 expression. Following stimulation with the dsRNA analog poly(I:C), R822Q IFIH1 resulted in higher levels of IFNB1 expression than wild-type IFIH1, indicating that R822Q IFIH1 is hyperactive to non-self dsRNA. There was also higher expression of interferon signature genes, such as IFI27, IFI44L, IFIT1, ISG15, RSG15, RSAD2 and SIGLEC1 in whole-blood samples from SMS patients, which was in agreement with the higher expression level of IFNB1 by R822Q IFIH1 (Rutsch et al. (2015) *Am. J. Hum. Genet.* 96:275-282).

The interferon signature observed in patients with another IFIH1 GOF mutation, A489T, is indicative of a type I interferonopathy; IFIH1 A489T is associated with increased interferon production and phenotypes resembling chilblain lupus, AGS and SMS (Bursztejn et al. (2015) *Br. J. Dermatol.* 173(6):1505-1513). The A489T variant not only resulted in IFN induction following stimulation with the long dsRNA analog poly(I:C), but also with short dsRNA. Two additional gain-of-function mutations in IFIH1, T331I and T331R, were identified in patients with SMS phenotypes, who presented with a significant upregulation of IFN-induced transcripts. The T331I and T331R variants resulted in increased expression of IFN-β, even in the absence of exogenous dsRNA ligand, consistent with the observed constitutive activation of MDA5 (Lu and MacDougall (2017) *Front. Genet.* 8:118).

A946T is another IFIH1 GOF mutation that leads to the increased production of type I IFN, promoting inflammation and increasing the risk of autoimmunity. The A946T mutation in IFIH1 results in additive effects when combined with the TMEM173 R232 allele and G207E GOF mutation, leading to a severe early-onset phenotype with features similar to SAVI (Keskitalo et al. (2018) preprint, available from doi.org/10.1101/394353). G821S is a GOF mutation in IFIH1 which has been shown to lead to spontaneously developed lupus-like autoimmune symptoms in a mouse model (Rutsch et al. (2015) *Am. J. Hum. Genet.* 96:275-282), while the IFIH1 missense mutations A452T, R779H and L372F, identified in individuals with AGS, were shown to cause type I interferon overproduction (Oda et al. (2014) *Am. J. Hum. Genet.* 95:121-125).

The tumor-targeting immunostimulatory bacteria provided herein, and also oncolytic viruses, can be modified to encode MDA5/IFIH1 (SEQ ID NO: 310) with gain-of-function mutations selected from T331I, T331R, R337G, L372F, D393V, A452T, A489T, G495R, R720Q, R779H, R779C, G821S, R822Q and A946T, singly or in any combination.

c. RIG-I

Retinoic acid-inducible gene I (RIG-I), also known as DDX58 (DEXD/H-box helicase 58) is another protein whose constitutive activation has been linked to the development interferonopathies, such as atypical SMS. RIG-I, like MDA5/IFIH1, is a member of the RIG-I-like receptor (RLR) family, and is a 925-residue cytosolic pattern recognition receptor that functions in the detection of viral dsRNA. RIG-I initiates an innate immune response to viral RNA through independent pathways that promote the expression of type I and type III IFNs and proinflammatory cytokines (Jang et al. (2015) *Am. J. Hum. Genet.* 96:266-274; Lu and MacDougall (2017) *Front. Genet.* 8:118).

Atypical SMS, without hallmark dental anomalies, but with variable phenotypes, including glaucoma, aortic calcification and skeletal abnormalities, has been found to be caused by mutations in the DEXD/H-box helicase 58 gene (DDX58), which encodes retinoic acid-inducible gene I (RIG-I). In particular, the mutations E373A and C268F in DDX58 were identified as causing gain-of-function in RIG-I. Elevated amounts of mutated DDX58 were associated with a significant increase in the basal levels of NF-κB reporter gene activity, and this activity was further increased by stimulation with the dsRNA analog poly(I:C). The RIG-I mutations also induced IRF-3 phosphorylation and dimerization at the basal level, and led to increased expression of IFNB1, interferon-stimulated gene 15 (ISG15), and chemokine (C-C motif) ligand 5 (CCL5) in both basal, and poly(I:C) transfected HEK293FT cells. These results indicate that the mutated DDX58/RIG-I results in constitutive activation, leading to increased IFN activity and IFN-stimulated gene expression (Jang et al. (2015) *Am. J. Hum. Genet.* 96:266-274; Lu and MacDougall (2017) *Front. Genet.* 8:118).

Tumor-targeting immunostimulatory bacteria, and oncolytic viruses, provided herein can be modified to encode RIG-I/DDX58 (SEQ ID NO: 311) with gain-of-function mutations such as, but not limited to, E373A and C268F, singly or in combination.

d. IRF-3 and IRF-7

Pathogen-associated molecular patterns (PAMPs) are recognized by host pattern recognition receptors (PRRs), such as the RIG-I-like receptors, RIG-I and MDA5, resulting in downstream signaling through the transcription factors IRF-3, IRF-7 and NF-κB, which leads to the production of type I IFNs.

IRF-3 (interferon regulatory factor 3) and IRF-7 are key activators of type I IFN genes. Following virus-induced C-terminal phosphorylation (by TBK1), activated IRF-3 and IRF-7 form homodimers, translocate from the cytoplasm to the nucleus, and bind to IFN-stimulated response elements (ISREs) to induce type I IFN responses. IRF-3 is expressed constitutively in unstimulated cells, and exists as an inactive cytoplasmic form, while IRF-7 is not constitutively expressed in cells, and is induced by IFN, lipopolysaccharide and virus infection. Overexpression of IRF-3 significantly increases the virus-mediated expression of type I IFN genes, resulting in the induction of an antiviral state. IRF-3 activation also has been shown to up-regulate the transcription of the CC-chemokine RANTES (CCL5) following viral infection (Lin et al. (1999)*Mol. Cell Biol.* 19(4):2465-2474).

Residues S385, S386, S396, S398, S402, T404 and S405 in the C-terminal domain of IRF-3 are phosphorylated after virus infection, inducing a conformational change that results in the activation of IRF-3. IRF-3 activation is induced, not only by viral infection, but also by lipopolysaccharide (LPS) and poly(I:C). Of the seven residues that can be phosphorylated in the C-terminal cluster of IRF-3, a single point mutation, S396D, is sufficient for the generation of a constitutively active form of IRF-3. IRF-3(S396D) enhances the transactivation of IFNα1, IFN-β and RANTES promoters by 13-, 14- and 11-fold, respectively, compared to wild-type IRF-3. Another mutant, IRF-3(S396D/S398D) enhances the transactivation of IFNα1, IFN-β and RANTES promoters by 13-, 12- and 12-fold, respectively, over wild-type IRF-3. Another constitutively active mutant of IRF3 is IRF-3(5D), in which the serine or threonine residues at positions 396, 398, 402, 404 and 405 are replaced by phosphomimetic aspartic acid residues (IRF-3(S396D/S398D/S402D/T404D/S405D)). Similar gain-of-function mutations, leading to constitutive activity of immune response mediators, such as induction of type I interferon, can be achieved by mutating serine residues to phosphomimetic aspartic acid in other proteins, such as RIG-I, MDA5 and STING, that are in immune response signaling pathways.

IRF-3(5D) displays constitutive DNA binding and transactivation activities, dimer formation, association with the transcription coactivators p300 (also called EP300 or E1A binding protein p300)/CBP (also known as CREB-binding protein or CREBBP), and nuclear localization. Its transactivation activity is not induced further by virus infection. IRF-3(5D) is a very strong activator of IFN-β and ISG15 gene expression; IRF-3(5D) alone stimulates IFN-β expression as strongly as virus infection, and enhances transactivation of IFNα1, IFN-β and RANTES promoters by 9-fold, 5.5-fold and 8-fold, respectively, over wild-type IRF-3 (see, e.g., Lin et al. (2000) *J. Biol. Chem.* 275(44):34320-34327; Lin et al. (1998) *Mol. Cell Biol.* 18(5):2986-2996; Servant et al. (2003) *J. Biol. Chem.* 278(11):9441-9447). Any of positions S385, S386, S396, S398, S402, T404 and S405 can be mutated, alone or in combination, to produce constitutively active IRF-3 mutants in the immunostimulatory bacteria, oncolytic viruses and other delivery agents, such as exosomes, provided herein.

Constitutively active forms of IRF-7 include mutants in which different C-terminal serines are substituted by phosphomimetic Asp, including IRF-7(S477D/S479D), IRF-7(S475D/S477D/S479D), and IRF-7(S475D/S476D/S477D/S479D/S483D/S487D). IRF-7(S477D/S479D) is a strong transactivator for IFNA and RANTES gene expression, and stimulates gene expression, even in the absence of virus infection. IRF-7(S475D/S477D/S479D), and IRF-7(S475D/S476D/S477D/S479D/S483D/S487D) do not further augment the transactivation activity of IRF-7(S477D/S479D), but the transactivation activity of all 3 mutants is stimulated further by virus infection. The mutant IRF-7(Δ247-467), which localizes to the nucleus in uninfected cells, is a very strong constitutive form of IRF-7; it activates transcription more than 1500-fold higher than wild-type IRF-7 in unstimulated and virus infected cells (Lin et al. (2000) *J. Biol. Chem.* 275(44):34320-34327). The immunostimulatory bacteria, viruses and other delivery agents, such as exosomes, provided herein, can encode and express constitutively active IRF-7 mutants, including those with replacements at residues 475-477, 479, 483 and 487, and those with amino acid deletions. The immunostimulatory bacteria encode these proteins on plasmids under the control of promoters and, any other desired regulatory signals, recognized by mammalian hosts, including humans.

8. Other Type I IFN Regulatory Proteins

Other proteins involved in the recognition of DNA/RNA that activate type I IFN responses can be mutated to generate constitutive type I IFN expression. The unmodified and/or modified proteins can be encoded in the immunostimulatory bacteria, oncolytic viruses, and other delivery vehicles, such as exosomes and liposomes, provided herein, to be used to deliver the protein to the tumor microenvironment, such as to tumor-resident immune cells, to increase expression of type I IFN.

These proteins include, but are not limited to, proteins designated as TRIM56, RIP1, Sec5, TRAF2, TRAF3, TRAF6, STAT1, LGP2, DDX3, DHX9, DDX1, DDX21, DHX15, DHX33, DHX36, DDX60, and SNRNP200.

| Gene | Encoded Protein | Activity/Function |
|---|---|---|
| TRIM56 | Tripartite motif-containing protein 56/E3 ubiquitin-protein ligase TRIM56 | Promotes dimerization of STING in response to dsDNA stimulation, resulting in production of IFN-β; potentiates extracellular dsRNA-induced expression of IFNB1 and IFN-stimulated genes ISG15, IFIT1/ISG56, CXCL10, OASL and CCL5; positive regulator of TL3 signaling |
| RIP1/RIPK1 | Receptor-interacting serine/threonine protein (kinase) 1 | Transduces inflammatory and cell-death signals (programmed necrosis) following death receptor ligation, activation of pathogen recognition receptors and DNA damage; indirectly activates NF-κB; directs LPS-induced IFN-β synthesis in mice |
| Sec5 (EX0C2) | Exocyst complex component 2 | Component of exocyst complex, involved in docking of exocytic vesicles with fusion sites on plasma membrane; co-localizes with STING and TBK1 after intracellular DNA stimulation, inducing type I IFN production |
| TRAF2 | TNF receptor-associated factor 2 | Regulates activation of NF-κB and JNK/MAPK8; mediates type I IFN induction |
| TRAF3 | TNF receptor-associated factor 3 | Regulates activation of NF-κB and MAP kinases; mediates activation of IRF-3; mediates type I IFN induction; mediates cytokine production |
| TRAF6 | TNF receptor-associated factor 6 | Activates NF-κB, JUN and AP-1; induces type I IFN production in response to viral infection and intracellular dsRNA; induces production of proinflammatory cytokines |
| STAT1 | Signal transducer and activator of transcription 1 | Forms part of ISGF3 transcription factor, which binds IFN stimulated response elements (ISREs) to activate transcription of IFN-stimulated genes (ISGs) |

-continued

| Gene | Encoded Protein | Activity/Function |
|---|---|---|
| LGP2 (DHX58) | Laboratory of genetics and physiology 2/ Probable ATP-dependent RNA helicase DHX58 | Regulates RIG-I/DDX58 and IFIH1/MDA5 mediated antiviral signaling |
| DDX3 (DDX3X) | ATP-dependent RNA helicase DDX3X | Promotes production of type I IFN; acts as viral RNA sensor; involved in TBK1 and IKBKE-dependent IRF-3 activation, leading to induction of IFNB; associates with IFNB promoters; associates with MAVS and RIG-I to induce signaling in early stages of infection; binds MDA5 to enhance its recognition of dsRNA |
| DHX9/DDX9 | DExD/H-box helicase 9/ ATP-dependent RNA helicase A | Senses viral nucleic acids; triggers host responses to non-self DNA in MyD88-dependent manner; interacts with MAVS to stimulate NF-kB-mediated innate immunity against virus infection and activate IRF-3 and MAPK pathways; potentiates virus-triggered induction of IL-6 and IFN-β |
| DDX1 | ATP-dependent RNA helicase DDX1 | Component of a multi-helicase-TRIF complex that senses viral double-stranded RNA (dsRNA), activates the NF-κB signaling pathway, and induces production of type I IFN and proinflammatory cytokines |
| DDX21 | Nucleolar RNA helicase 2 | Component of a multi-helicase-TRIF complex that senses viral double-stranded RNA (dsRNA), activates the NF-κB signaling pathway, and induces production of type I IFN and proinflammatory cytokines |
| DHX15 (DDX15) | Pre-mRNA-splicing factor ATP-dependent RNA helicase DHX15 | Viral RNA sensor that interacts with MAVS to induce type I IFN and proinflammatory cytokine production; activates IRF-3, NF-κB and MAPK signaling |
| DHX33 (DDX33) | ATP-dependent RNA helicase DHX33 | Viral dsRNA sensor that interacts with MAVS and triggers type I IFN response; activates NF-κB, IRF-3 and MAPK signaling pathways; activates NLRP3 inflammasome, resulting in secretion of proinflammatory cytokines |
| DHX36 (DDX36) | ATP-dependent DNA/RNA helicase DHX36 | Component of a multi-helicase-TRIF complex that senses viral double-stranded RNA (dsRNA), activates the NF-κB signaling pathway, and induces production of type I IFN and proinflammatory cytokines |
| DDX60 | Probable ATP-dependent RNA helicase DDX60 | Senses viral RNA and DNA; forms complex with RIG-I like receptors to promote antivirus activity; positively regulates RIG-I and MDA5-dependent type I IFN and IFN-inducible gene expression in response to viral infection; binds ssRNA, dsRNA and dsDNA; promotes binding of RIG-I to dsRNA |
| SNRNP200 | U5 small nuclear ribonucleoprotein 200 kDa helicase | Senses/binds viral RNA and interacts with TBK1 to promote IRF-3 activation and type I IFN production |

Site-directed mutagenesis can be performed in vitro to identify mutations with enhanced activity, that lead to higher level and/or constitutive type I IFN expression. Intact genomic DNA can be obtained from non-related patients experiencing autoimmune and auto-inflammatory symptoms, and from healthy individuals, to screen for and identify other products whose expression leads to increased or constitutive type I IFN expression. Whole exome sequencing can be performed, and introns and exons can be analyzed, such that proteins with mutations in the pathways associated with the increased or constitutive expression of type I interferon are identified. After identification of mutations, cDNA molecules encoding the full-length gene, with and without the identified mutation(s), are transfected into a reporter cell line that measures expression of type I interferon. For example, a reporter cell line can be generated where the expression of luciferase is placed under the promoter for IFN-β. A gain-of-function mutant that is constitutively active will promote the expression of IFN-β, whereas the unstimulated wild-type protein will not. Stimulation can be by virus infection, bacterial infection, bacterial nucleic acids, LPS, dsRNA, poly(I:C), or by increasing exogenous levels of the protein's ligand (e.g., CDNs). Identified proteins also include those that enhance an immune response to an antigen(s) of interest in a subject. The immune response comprises a cellular or humoral immune response characterized by one or more of: (i) stimulating type I interferon pathway signaling; (ii) stimulating NF-κB pathway signaling; (iii) stimulating an inflammatory response; (iv) stimulating cytokine production; (v) stimulating dendritic cell development, activity or mobilization; (vi) any other responses indicative of a product whose expression enhances an immune response; and (vii) a combination of any of (i)-(vi).

9. Other Therapeutic Products

Immunostimulatory Proteins

The immunostimulatory bacteria also can encode immunostimulatory proteins, such as cytokines, including chemokines, that enhance or stimulate or evoke an anti-tumor immune response, particularly when expressed in tumors, in the tumor microenvironment and/or in tumor-resident immune cells. The immunostimulatory bacteria herein can be modified to encode an immunostimulatory protein that promotes or induces or enhances an anti-tumor response. The immunostimulatory protein can be encoded on a plasmid in the bacterium, under the control of a eukaryotic promoter, such as a promoter recognized by RNA polymerase II, for expression in a eukaryotic subject, particularly the subject for whom the immunostimulatory bacterium is to be administered, such as a human. The nucleic acid encoding the immunostimulatory protein can include, in addition to the eukaryotic promoter, other regulatory signals for expression or trafficking in the cells, such as for secretion or expression on the surface of a cell.

The immunostimulatory bacteria herein can be modified to encode an immunostimulatory protein that promotes or induces or enhances an anti-tumor response. The immunostimulatory protein can be encoded on a plasmid in the bacterium, under the control of a eukaryotic promoter, such as a promoter recognized by RNA polymerase II, for expression in a eukaryotic subject, particularly the subject for whom the immunostimulatory bacterium is to be administered, such as a human. The nucleic acid encoding the immunostimulatory protein can include, in addition to the eukaryotic promoter, other regulatory signals for expression or trafficking in the cells, such as for secretion or expression on the surface of a cell.

Immunostimulatory proteins are those that, in the appropriate environment, such as a tumor microenvironment (TME), can promote or participate in or enhance an anti-tumor response by the subject to whom the immunostimulatory bacterium is administered. Immunostimulatory proteins include, but are not limited to, cytokines, chemokines and co-stimulatory molecules. These include cytokines, such as, but not limited to, IL-2, IL-7, IL-12, IL-15, and IL-18; chemokines, such as, but not limited to, CCL3, CCL4, CCL5, CXCL9, CXCL10, and CXCL11; and/or co-stimulatory molecules, such as, but not limited to, CD40, CD40L, OX40, OX40L, 4-1BB, 4-1BBL, members of the TNF/TNFR superfamily and members of the B7-CD28 family. Other such immunostimulatory proteins that are used for treatment of tumors or that can promote, enhance or otherwise increase or evoke an anti-tumor response, known to those of skill in the art, are contemplated for encoding in the immunostimulatory bacteria provided herein.

In some embodiments, the immunostimulatory bacteria herein are engineered to express cytokines to stimulate the immune system, including, but not limited to, IL-2, IL-7, IL-12 (IL-12p70 (IL-12p40+IL-12p35)), IL-15 (and the IL-15:IL-15R alpha chain complex), and IL-18. Cytokines stimulate immune effector cells and stromal cells at the tumor site, and enhance tumor cell recognition by cytotoxic cells. In some embodiments, the immunostimulatory bacteria can be engineered to express chemokines, such as, for example, CCL3, CCL4, CCL5, CXCL9, CXCL10 and CXCL11. These modifications and bacteria encoding them are discussed above, and exemplified below.

Immunostimulatory Bacteria Encoding Cytokines and Chemokines

In some embodiments, the immunostimulatory bacteria herein are engineered to express cytokines to stimulate the immune system, including, but not limited to, IL-2, IL-7, IL-12 (IL-12p70 (IL-12p40+IL-12p35)), IL-15 (and the IL-15:IL-15R alpha chain complex), and IL-18. Cytokines stimulate immune effector cells and stromal cells at the tumor site, and enhance tumor cell recognition by cytotoxic cells. In some embodiments, the immunostimulatory bacteria can be engineered to express chemokines, such as, for example, CCL3, CCL4, CCL5, CXCL9, CXCL10 and CXCL11.

Immunostimulatory proteins are those that, in the appropriate environment, such as a tumor microenvironment (TME), can promote or participate in or enhance an anti-tumor response by the subject to whom the immunostimulatory bacterium is administered. Immunostimulatory proteins include, but are not limited to, cytokines, chemokines and co-stimulatory molecules. These include cytokines, such as, but not limited to, IL-2, IL-7, IL-12, IL-15, and IL-18; chemokines, such as, but not limited to, CCL3, CCL4, CCL5, CXCL9, CXCL10, and CXCL11; and/or co-stimulatory molecules, such as, but not limited to, CD40, CD40L, OX40, OX40L, 4-1BB, 4-1BBL, members of the TNF/TNFR superfamily and members of the B7-CD28 family. Other such immunostimulatory proteins that are used for treatment of tumors or that can promote, enhance or otherwise increase or evoke an anti-tumor response, known to those of skill in the art, are contemplated for encoding in the immunostimulatory bacteria provided herein.

The genome of the immunostimulatory bacteria provided herein also can be modified to increase or promote infection of immune cells, particularly immune cells in the tumor microenvironment, such as phagocytic cells. The bacteria also can be modified to decrease pyroptosis in immune cells. The immunostimulatory bacteria include those, for example, that have modifications that disrupt/inhibit the SPI-1 pathway, such as disruption or deletion of hilA, and/or disruption/deletion of flagellin genes, rod protein, needle protein, and/or pagP, as detailed and exemplified elsewhere herein.

IL-2

Interleukin-2 (IL-2), which was the first cytokine approved for the treatment of cancer, is implicated in the activation of the immune system by several mechanisms, including the activation and promotion of CTL growth, the generation of lymphokine-activated killer (LAK) cells, the promotion of Treg cell growth and proliferation, the stimulation of TILs, and the promotion of T cell, B cell and NK cell proliferation and differentiation. Recombinant IL-2 (rIL-2) is FDA-approved for the treatment of metastatic renal cell carcinoma (RCC) and metastatic melanoma (Sheikhi et al. (2016) *Iran J. Immunol.* 13(3):148-166).

IL-7

IL-7, which is a member of the IL-2 superfamily, is implicated in the survival, proliferation and homeostasis of T cells. Mutations in the IL-7 receptor have been shown to result in the loss of T cells, and the development of severe combined immunodeficiency (SCID), highlighting the critical role that IL-7 plays in T cell development. IL-7 is a homeostatic cytokine that provides continuous signals to resting naïve and memory T cells, and which accumulates during conditions of lymphopenia, leading to an increase in both T cell proliferation and T cell repertoire diversity. In comparison to IL-2, IL-7 is selective for expanding $CD8^+$ T cells over $CD4^+$ $FOXP3^+$ regulatory T cells. Recombinant IL-7 has been shown to augment antigen-specific T cell responses following vaccination and adoptive cell therapy in mice. IL-7 also can play a role in promoting T-cell recovery following chemotherapy of hematopoietic stem cell transplantation. Early phase clinical trials on patients with advanced malignancy have shown that recombinant IL-7 is well-tolerated and has limited toxicity at biologically active doses (i.e., in which the numbers of circulating $CD4^+$ and $CD8^+$ T cells increased by 3-4 fold) (Lee, S. and Margolin, K. (2011) *Cancers* 3:3856-3893). IL-7 has been shown to possess antitumor effects in tumors such as gliomas, melanomas, lymphomas, leukemia, prostate cancer and glioblastoma, and the in vivo administration of IL-7 in murine models resulted in decreased cancer cell growth. IL-7 also has been shown to enhance the antitumor effects of IFN-γ in rat glioma tumors, and to induce the production of IL-1α, IL-1β and TNF-α by monocytes, which results in the inhibition of melanoma growth. Additionally, administration of recombinant IL-7 following the treatment of pediatric sarcomas resulted in the promotion of immune recovery (Lin et al. (2017) *Anticancer Research* 37:963-968).

IL-12 (IL-12p70 (IL-12p40+IL-12p35)

Bioactive IL-12 (IL-12p70), which promotes cell-mediated immunity, is a heterodimer, composed of p35 and p40 subunits, whereas IL-12p40 monomers and homodimers act as IL-12 antagonists. IL-12, which is secreted by antigen-presenting cells, promotes the secretion of IFN-γ from NK and T cells, inhibits tumor angiogenesis, results in the activation and proliferation of NK cells, $CD8^+$ T cells and $CD4^+$ T cells, enhances the differentiation of $CD4^+$ Th0 cells into Th1 cells, and promotes antibody-dependent cell-mediated cytotoxicity (ADCC) against tumor cells. IL-12 has been shown to exhibit antitumor effects in murine models of melanoma, colon carcinoma, mammary carcinoma and sarcoma (Kalinski et al. (2001) *Blood* 97:3466-3469; Sheikhi et al. (2016) *Iran J. Immunol.* 13(3):148-166; Lee, S. and Margolin, K. (2011) *Cancers* 3:3856-3893).

IL-15 and IL-15:IL-15Rα

IL-15 is structurally similar to IL-2, and while both IL-2 and IL-15 provide early stimulation for the proliferation and activation of T cells, IL-15 blocks IL-2 induced apoptosis, which is a process that leads to the elimination of stimulated T cells and induction of T-cell tolerance, limiting memory T cell responses and potentially limiting the therapeutic efficacy of IL-2 alone. IL-15 also supports the persistence of memory $CD8^+$ T cells for maintaining long-term antitumor immunity, and has demonstrated significant antitumor activity in pre-clinical murine models via the direct activation of $CD8^+$ effector T cells in an antigen-independent manner. In addition to $CD8^+$ T cells, IL-15 is responsible for the development, proliferation and activation of effector natural killer (NK) cells (Lee, S. and Margolin, K. (2011) *Cancers* 3:3856-3893; Han et al. (2011) *Cytokine* 56(3):804-810).

IL-15 and IL-15 receptor alpha (IL-15Rα) are coordinately expressed by antigen-presenting cells such as monocytes and dendritic cells, and IL-15 is presented in trans by IL-15Rα to the IL-15$\beta\gamma_C$ receptor complex expressed on the surfaces of $CD8^+$ T cells and NK cells. Soluble IL-15:IL15-Rα complexes have been shown to modulate immune responses via the IL-15$\beta\gamma_C$ complex, and the biological activity of IL-15 has been shown to be increased 50-fold by administering it in a preformed complex of IL-15 and soluble IL-15Rα, which has an increased half-life compared to IL-15 alone. This significant increase in the therapeutic efficacy of IL-15 by pre-association with IL-15Rα has been demonstrated in murine tumor models (Han et al. (2011) *Cytokine* 56(3):804-810).

IL-18

IL-18 induces the secretion of IFN-γ by NK and $CD8^+$ T cells, enhancing their toxicity. IL-18 also activates macrophages and stimulates the development of Th1 helper $CD4^+$ T cells. IL-18 has shown promising anti-tumor activity in several preclinical mouse models. For example, administration of recombinant IL-18 (rIL-18) resulted in the regression of melanoma or sarcoma in syngeneic mice through the activation of $CD4^+$ T cells and/or NK cell-mediated responses. Other studies showed that IL-18 anti-tumor effects were mediated by IFN-γ and involved antiangiogenic mechanisms. The combination of IL-18 with other cytokines, such as IL-12, or with co-stimulatory molecules, such as CD80, enhances the IL-18-mediated anti-tumor effects. Phase I clinical trials in patients with advanced solid tumors and lymphomas showed that IL-18 administration was safe, and that it resulted in immune modulatory activity and in the increase of serum IFN-γ and GM-CSF levels in patients and modest clinical responses. Clinical trials showed that IL-18 can be combined with other anticancer therapeutic agents, such as monoclonal antibodies, cytotoxic drugs or vaccines (Fabbi et al. (2015) *J. Leukoc. Biol.* 97:665-675; Lee, S. and Margolin, K. (2011) *Cancers* 3:3856-3893).

It was found that an attenuated strain of *Salmonella typhimurium*, engineered to express IL-18, inhibited the growth of subcutaneous (s.c.) tumors or pulmonary metastases in syngeneic mice without any toxic effects following systemic administration. Treatment with this engineered bacterium induced the accumulation of T cells, NK cells and granulocytes in tumors, and resulted in the intratumoral production of cytokines (Fabbi et al. (2015) *J. Leukoc. Biol.* 97:665-675).

Chemokines

Chemokines are a family of small cytokines that mediate leukocyte migration to areas of injury or inflammation and are involved in mediating immune and inflammatory responses. Chemokines are classified into four subfamilies, based on the position of cysteine residues in their sequences, namely XC-, CC-, CXC- and CX3C-chemokine ligands, or XCL, CCL, CXCL and CX3CL. The chemokine ligands bind to their cognate receptors and regulate the circulation, homing and retention of immune cells, with each chemokine ligand-receptor pair selectively regulating a certain type of immune cell. Different chemokines attract different leukocyte populations, and form a concentration gradient in vivo, with attracted immune cells moving through the gradient towards the higher concentration of chemokine (Argyle D. and Kitamura, T. (2018) *Front. Immunol.* 9:2629; Dubinett et al. (2010) *Cancer J.* 16(4):325-335). Chemokines can improve the antitumor immune response by increasing the infiltration of immune cells into the tumor, and facilitating the movement of antigen-presenting cells (APCs) to tumor-draining lymph nodes, which primes naïve T cells and B cells (Lechner et al. (2011) *Immunotherapy* 3(11):1317-1340). The immunostimulatory bacteria herein can be engineered to encode chemokines, including, but not limited to, CCL3, CCL4, CCL5, CXCL9, CXCL10 and CXCL11.

CCL3, CCL4, CCL5

CCL3, CCL4 and CCL5 share a high degree of homology, and bind to CCR5 (CCL3, CCL4 and CCL5) and CCR1 (CCL3 and CCL5) on several cell types, including immature DCs and T cells, in both humans and mice. Therapeutic T cells have been shown to induce chemotaxis of innate immune cells to tumor sites, via the tumor-specific secretion of CCL3, CCL4 and CCL5 (Dubinett et al. (2010) *Cancer J.* 16(4):325-335).

The induction of the T helper cell type 1 (Th1) response releases CCL3. In vivo and in vitro studies of mice have indicated that CCL3 is chemotactic for both neutrophils and monocytes; specifically, CCL3 can mediate myeloid precursor cell (MPC) mobilization from the bone marrow, and has MPC regulatory and stimulatory effects. Human ovarian carcinoma cells transfected with CCL3 showed enhanced T cell infiltration and macrophages within the tumor, leading to an improved antitumor response, and indicated that CCL3-mediated chemotaxis of neutrophils suppressed tumor growth. DCs transfected with the tumor antigen human melanoma-associated gene (MAGE)-1 that were recruited by CCL3 exhibited superior anti-tumor effects, including increased lymphocyte proliferation, cytolytic capacity, survival, and decreased tumor growth in a mouse model of melanoma. A combinatorial use of CCL3 with an antigen-specific platform for MAGE-1 has also been used in the treatment of gastric cancer. CCL3 production by CT26, a highly immunogenic murine colon tumor, slowed in vivo tumor growth; this process was indicated to be driven by the CCL3-dependent accumulation of natural killer (NK) cells, and thus, IFNγ, resulting in the production of CXCL9 and CXLC10 (Allen et al. (2017) *Oncoimmunology* 7(3): e1393598; Schaller et al. (2017) *Expert Rev. Clin. Immunol.* 13(11):1049-1060).

CCL3 has been used as an adjuvant for the treatment of cancer. Administration of a CCL3 active variant, ECI301, after radiofrequency ablation in mouse hepatocellular carcinoma increased tumor-specific responses, and this mechanism was further shown to be dependent on the expression of CCR1. CCL3 has also shown success as an adjuvant in systemic cancers, whereby mice vaccinated with CCL3 and IL-2 or granulocyte-macrophage colony-stimulating factor (GM-CSF) in a model of leukemia/lymphoma exhibited increased survival (Schaller et al. (2017) *Expert Rev. Clin. Immunol.* 13(11): 1049-1060).

CCL3 and CCL4 play a role in directing $CD8^+$ T cell infiltration into primary tumor sites in melanoma and colon cancers. Tumor production of CCL4 leads to the accumulation of $CD103^+$ DCs; suppression of CCL4 through a WNT/β-catenin-dependent pathway prevented $CD103^+$ DC infiltration of melanoma tumors (Spranger et al. (2015) *Nature* 523(7559):231-235). CCL3 was also shown to enhance $CD4^+$ and $CD8^+$ T cell infiltration to the primary tumor site in a mouse model of colon cancer (Allen et al. (2017) *Oncoimmunology* 7(3):e1393598).

The binding of CCL3 or CCL5 to their receptors (CCR1 and CCR5, respectively), moves immature DCs, monocytes and memory and T effector cells from the circulation into sites of inflammation or infection. For example, CCL5 expression in colorectal tumors contributes to T lymphocyte chemoattraction and survival. CCL3 and CCL5 have been used alone or in combination therapy to induce tumor regression and immunity in several preclinical models. For example, studies have shown that the subcutaneous injection of Chinese hamster ovary cells genetically modified to express CCL3 resulted in tumor inhibition and neutrophilic infiltration. In another study, a recombinant oncolytic adenovirus expression CCL5 (Ad-RANTES-E1A) resulted in primary tumor regression and blocked metastasis in a mammary carcinoma murine model (Lechner et al. (2011) *Immunotherapy* 3(11):1317-1340).

In a translational study of colorectal cancer, CCL5 induced an "antiviral response pattern" in macrophages. As a result of CXCR3 mediated migration of lymphocytes at the invasive margin of liver metastases in colorectal cancer, CCL5 is produced. Blockade of CCR5, the CCL5 receptor, results in tumor death, driven by macrophages producing IFN and reactive oxygen species. While macrophages are present in the tumor microenvironment, CCR5 inhibition induces a phenotypic shift from an M2 to an M1 phenotype. CCR5 blockade also leads to clinical responses in colorectal cancer patients (Halama et al. (2016) *Cancer Cell* 29(4): 587-601).

CCL3, CCL4 and CCL5 can be used treating conditions including lymphatic tumors, bladder cancer, colorectal cancer, lung cancer, melanoma, pancreatic cancer, ovarian cancer, cervical cancer or liver cancer (U.S. Patent Publication No. US 2015/0232880; International Patent Publication Nos. WO 2015/059303, WO 2017/043815, WO 2017/156349 and WO 2018/191654).

CXCL9, CXCL10, CXCL11

CXCL9 (MIG), CXCL10 (IP10) and CXCL11 (ITAC) are induced by the production of IFN-γ. These chemokines bind CXCR3, preferentially expressed on activated T cells, and function both angiostatically and in the recruitment and activation of leukocytes. Prognosis in colorectal cancer is strongly correlated to tumor-infiltrating T cells, particularly Th1 and $CD8^+$ effector T cells; high intratumoral expression of CXCL9, CXCL10 and CXCL11 is indicative of good prognosis. For example, in a sample of 163 patients with colon cancer, those with high levels of CXCL9 or CXCL11 showed increased post-operative survival, and patients with high CXC expression had significantly higher numbers of $CD3^+$ T-cells, $CD4^+$ T-helper cells, and $CD8^+$ cytotoxic T-cells. In liver metastases of colorectal cancer patients, CXCL9 and CXCL10 levels were increased at the invasive margin and correlated with effector T cell density. The stimulation of lymphocyte migration via the action of CXCL9 and CXCL10 on CXCR3 leads to the production of CCL5 at the invasive margin (Halama et al. (2016) *Cancer Cell* 29(4):587-601; Kistner et al. (2017) *Oncotarget* 8(52): 89998-90012).

In vivo, CXCL9 functions as a chemoattractant for tumor-infiltrating lymphocytes, activated peripheral blood lymphocytes, natural killer (NK) cells and Th1 lymphocytes. CXCL9 also is critical for T cell-mediated suppression of cutaneous tumors. For example, when combined with systemic IL-2, CXCL9 has been shown to inhibit tumor growth via the increased intratumoral infiltration of $CXCR3^+$ mononuclear cells. In a murine model of colon carcinoma, a combination of the huKS1/4-IL-2 fusion protein with CXCL9 gene therapy achieved a superior anti-tumor effect and prolonged lifespan through the chemoattraction and activation of $CD8^+$ and $CD4^+$ T lymphocytes (Dubinett et al. (2010) *Cancer J.* 16(4):325-335; Ruehlmann et al. (2001) *Cancer Res.* 61(23):8498-8503).

CXCL10, produced by activated monocytes, fibroblasts, endothelial cells and keratinocytes, is chemotactic for activated T cells and can act as an inhibitor of angiogenesis in vivo. Expression of CXCL10 in colorectal tumors has been shown to contribute to cytotoxic T lymphocyte chemoattraction and longer survival. The administration of immunostimulatory cytokines, such as IL-12, has been shown to enhance the antitumor effects generated by CXCL10. A DC vaccine primed with a tumor cell lysate and transfected with CXCL10 had increased immunological protection and effectiveness in mice; the animals showed a resistance to a tumor challenge, a slowing of tumor growth and longer survival time. In vivo and in vitro studies in mice using the CXCL10-mucin-GPI fusion protein resulted in tumors with higher levels of recruited NK cells compared to tumors not treated with the fusion protein. Interferons (which can be produced by plasmacytoid dendritic cells; these cells are associated with primary melanoma lesions and can be recruited to a tumor site by CCL20) can act on tumor DC subsets, for example, $CD103^+$ DCs, which have been shown to produce CXCL9/10 in a mouse melanoma model and were associated with CXCL9/10 in human disease. CXCL10 also has shown higher expression in human metastatic melanoma samples relative to primary melanoma samples. Therapeutically, adjuvant IFN-α melanoma therapy upregulates CXCL10 production, whereas the chemotherapy agent cisplatin induces CXCL9 and CXCL10 (Dubinett et al. (2010) *Cancer J.* 16(4):325-335; Kuo et al. (2018) *Front. Med.* (*Lausanne*) 5:271; Li et al. (2007) *Scand. J. Immunol.* 65(1):8-13; Muenchmeier et al. (2013) *PLoS One* 8(8): e72749).

CXCL10/11 and CXCR3 expression has been established in human keratinocytes derived from basal cell carcinomas (BCCs). CXCL11 also is capable of promoting immunosuppressive indoleamine 2,3-dioxygenase (IDO) expression in human basal cell carcinoma as well as enhancing keratinocyte proliferation, which could reduce the anti-tumor activity of any infiltrating $CXCR3^+$ effector T cells (Kuo et al. (2018) *Front. Med.* (*Lausanne*) 5:271).

CXCL9, CXCL10 and CXCL11 can be encoded in oncolytic viruses for treating cancer (U.S. Patent Publication No. US 2015/0232880; International Patent Publication No. WO 2015/059303). Pseudotyped oncolytic viruses or a genetically engineered bacterium encoding the gene for CXCL10 also can be used to treat cancer (International Application Publication Nos. WO 2018/006005 and WO 2018/129404).

Co-Stimulatory Molecules

Co-stimulatory molecules enhance the immune response against tumor cells, and co-stimulatory pathways are inhibited by tumor cells to promote tumorigenesis. The immunostimulatory bacteria herein can be engineered to express co-stimulatory molecules, such as, for example, CD40, CD40L, 4-1BB, 4-1BBL, OX40 (CD134), OX40L (CD252), other members of the TNFR superfamily (e.g., CD27, GITR, CD30, Fas receptor, TRAIL-R, TNF-R, HVEM, RANK), B7 and CD28. The immunostimulatory bacteria herein also can be engineered to express agonistic antibodies against co-stimulatory molecules to enhance the anti-tumor immune response.

TNF Receptor Superfamily

The TNF superfamily of ligands (TNF SF) and their receptors (TNFRSF) are involved in the proliferation, differentiation, activation and survival of tumor and immune effector cells. Members of this family include CD30, Fas-L, TRAIL-R and TNF-R, which induce apoptosis, and CD27, OX40L, CD40L, GITR-L and 4-1BBL, which regulate B and T cell immune responses. Other members include herpesvirus entry mediator (HVEM). The expression of TNFSF and TNFRSF by the immunostimulatory bacteria herein can enhance the antitumor immune response. It has been shown, for example, that the expression of 4-1BBL in murine tumors enhances immunogenicity, and intratumoral injection of dendritic cells (DCs) with increased expression of OX40L can result in tumor rejection in murine models. Studies have also shown that injection of an adenovirus expressing recombinant GITR into B16 melanoma cells promotes T cell infiltration and reduces tumor volume. Stimulatory antibodies against molecules such as 4-1BB, OX40 and GITR also can be encoded by the immunostimulatory bacteria to stimulate the immune system. For example, agonistic anti-4-1BB monoclonal antibodies have been shown to enhance anti-tumor CTL responses, and agonistic anti-OX40 antibodies have been shown to increase anti-tumor activity in transplantable tumor models. Additionally, agonistic anti-GITR antibodies have been shown to enhance anti-tumor responses and immunity (Lechner et al. (2011) *Immunotherapy* 3(11):1317-1340; Peggs et al. (2009) *Clinical and Experimental Immunology* 157:9-19).

CD40 and CD40L

CD40, which is a member of the TNF receptor superfamily, is expressed by APCs and B cells, while its ligand, CD40L (CD154), is expressed by activated T cells. Interaction between CD40 and CD40L stimulates B cells to produce cytokines, resulting in T cell activation and tumor cell death. Studies have shown that antitumor immune responses are impaired with reduced expression of CD40L on T cells or CD40 on dendritic cells. CD40 is expressed on the surface of several B-cell tumors, such as follicular lymphoma, Burkitt lymphoma, lymphoblastic leukemia, and chronic lymphocytic leukemia, and its interaction with CD40L has been shown to increase the expression of B7.1/CD80, B7.2/CD86 and HLA class II molecules in the $CD40^+$ tumor cells, as well as enhance their antigen-presenting abilities. Transgenic expression of CD40L in a murine model of multiple myeloma resulted in the induction of $CD4^+$ and $CD8^+$ T cells, local and systemic antitumor immune responses and reduced tumor growth. Anti-CD40 agonistic antibodies also induced anti-tumor T cell responses (Marin-Acevedo et al. (2018) *Journal of Hematology & Oncology* 11:39; Dotti et al. (2002) *Blood* 100(1):200-207; Murugaiyan et al. (2007) *J. Immunol.* 178:2047-2055).

4-1BB and 4-1BBL 4-1BB (CD137) is an inducible co-stimulatory receptor that is expressed by T cells, NK cells and APCs, including DCs, B cells and monocytes, which binds its ligand, 4-1BBL to trigger immune cell proliferation and activation. 4-1BB results in longer and more wide spread responses of activated T cells. Anti-4-1BB agonists and 4-1BBL fusion proteins have been shown to increase immune-mediated antitumor activity, for example, against sarcoma and mastocytoma tumors, mediated by $CD4^+$ and $CD^+$ T cells and tumor-specific CTL activity (Lechner et al. (2011) *Immunotherapy* 3(11):1317-1340; Marin-Acevedo et al. (2018) *Journal of Hematology & Oncology* 11:39).

OX40 and OX40L

OX40 (CD134) is a member of the TNF receptor superfamily that is expressed on activated effector T cells, while its ligand, OX40L is expressed on APCs, including DCs, B cells and macrophages, following activation by TLR agonists and CD40-CD40L signaling. OX40-OX40L signaling results in the activation, potentiation, proliferation and survival of T cells, as well as the modulation of NK cell function and inhibition of the suppressive activity of Tregs. Signaling through OX40 also results in the secretion of cytokines (IL-2, IL-4, IL-5 and IFN-γ), boosting Th1 and Th2 cell responses. The recognition of tumor antigens by TILs results in increased expression of OX40 by the TILs, which has been correlated with improved prognosis. Studies have demonstrated that treatment with anti-OX40 agonist antibodies or Fc-OX40L fusion proteins results in enhanced tumor-specific $CD4^+$ T cell responses and increased survival in murine models of melanoma, sarcoma, colon carcinoma and breast cancer, while Fc-OX40L incorporated into tumor cell vaccines protected mice from subsequent challenge with breast carcinoma cells (Lechner et al. (2011) *Immunotherapy* 3(11): 1317-1340; Marin-Acevedo et al. (2018) *Journal of Hematology & Oncology* 11:39).

B7-CD28 Family

CD28 is a costimulatory molecule expressed on the surface of T cells that acts as a receptor for B7-1 (CD80) and B7-2 (CD86), which are co-stimulatory molecules expressed on antigen-presenting cells. CD28-B7 signaling is required for T cell activation and survival, and prevention of T cell anergy, and results in the production of interleukins such as IL-6.

Optimal T-cell priming requires two signals: (1) T-cell receptor (TCR) recognition of WIC-presented antigens and (2) co-stimulatory signals resulting from the ligation of T-cell CD28 with B7-1 (CD80) or B7-2 (CD86) expressed on APCs. Following T cell activation, CTLA-4 receptors are induced, which then outcompete CD28 for binding to B7-1 and B7-2 ligands. Antigen presentation by tumor cells is poor due to their lack of expression of costimulatory molecules such as B7-1/CD80 and B7-2/CD86, resulting in a failure to activate the T-cell receptor complex. As a result, upregulation of these molecules on the surfaces of tumor cells can enhance their immunogenicity. Immunotherapy of solid tumors and hematologic malignancies has been successfully induced by B7, for example, via tumor cell expression of B7, or soluble B7-immunoglobulin fusion proteins. The viral-mediated tumor expression of B7, in combination with other co-stimulatory ligands such as ICAM-3 and LFA-3, has been successful in preclinical and clinical trials for the treatment of chronic lymphocytic leukemia and metastatic melanoma. Additionally, soluble B7 fusion proteins have demonstrated promising results in the immunotherapy of solid tumors as single agent immunotherapies (Lechner et al. (2011) *Immunotherapy* 3(11):1317-1340; Dotti et al. (2002) *Blood* 100(1):200-207).

F. IMMUNOSTIMULATORY BACTERIA ENCODING THE PROTEINS AND CONSTRUCTION OF EXEMPLARY PLASMIDS AND DELIVERY VEHICLES

The therapeutic products, including those described above, are encoded in the immunostimulatory bacteria provided herein on a plasmid and generally under the control of host-recognized regulatory signals. The immunostimulatory bacteria provided herein are modified to increase accumulation in tumor-resident immune cells and the tumor microenvironment. They include modifications to the bacterial genome, bacterial expression and host cell invasion, discussed above, such as to improve or increase targeting to or accumulation in tumors, tumor-resident immune cells, and the tumor microenvironment, and also, to include plasmids that encode products that are expressed in the bacteria by including a bacterial promoter, or in the host by including an appropriate eukaryotic promoter and other regulatory regions as appropriate. The immunostimulatory bacteria are modified as described above, such as by deletion of flagella, and other modifications, so that the bacteria are one or more of asd$^-$, msbB$^-$, and pagP$^-$, and are adenosine auxotrophs.

To introduce the plasmids, the bacteria are transformed using standard methods, such as electroporation with purified DNA plasmids constructed with routine molecular biology tools and methods (DNA synthesis, PCR amplification, DNA restriction enzyme digestion and ligation of compatible cohesive end fragments with ligase). As discussed below and elsewhere herein, the plasmids encode proteins, such as immunostimulatory proteins, such as interleukins, and/or modified gain-of-function proteins, under the control of host-recognized promoters. These encoded proteins stimulate the immune system, particularly in the tumor microenvironment.

The bacteria can encode other products on the plasmids, generally expressed under control of a eukaryotic promoter, such as an RNA polymerase (RNAP) II or III promoter. Typically, RNAPIII (also referred to as POLIII) promoters are constitutive, and RNAPII (also referred to as POLII) can be regulated. As provided herein, bacterial strains, such as strains of *Salmonella*, including *S. typhimurium*, are modified or identified to be auxotrophic for adenosine in the tumor microenvironment, and to carry plasmids encoding therapeutic proteins, such as the STING and other immunostimulatory proteins that are part of a cytosolic DNA/RNA sensor pathway leading to expression of type I IFN, and also variants of these proteins that increase expression of type I IFN or that result in constitutive expression of type I IFN.

Encoded therapeutic products, for example, on plasmids in the immunostimulatory bacteria provided herein, include cytosolic DNA/RNA sensors that induce type I IFNs, as well as constitutively active variants thereof. These include, for example STING, RIG-I, MDA5, IRF-3 and IRF-7, as well as GOF variants thereof, that constitutively induce type I IFN, and/or are activated and induce type I IFN in the absence of stimulation by ligands, such as cytosolic nucleic acid, including CDNs. Encoded STING proteins include wild-type and GOF variants of human STING (including allelic variants), as well as wild-type or modified STING (e.g., GOF variants) from other species, such as Tasmanian devil, marmoset, cattle, cat, ostrich, boar, bat, manatee, crested ibis, coelacanth, mouse and ghost shark, which can exhibit lower NF-κB activity, and optionally, increased IRF3/type I IFN signaling. Other therapeutic products include immunostimulatory proteins such as cytokines, chemokines, and co-stimulatory molecules.

Bacteria, such as *S. typhimurium*, can infect multiple cell types, including tumor cells and macrophages. For cells infected with the immunostimulatory bacteria, such as *S. typhimurium*, the plasmid is released and encoded proteins are transcribed by host RNA polymerases and are secreted into the tumor microenvironment and tumors.

1. Origin of Replication and Plasmid Copy Number

Plasmids are autonomously-replicating extra-chromosomal circular double stranded DNA molecules that are maintained within bacteria by means of a replication origin. Copy number influences the plasmid stability. High copy number generally results in greater stability of the plasmid when the random partitioning occurs at cell division. A high number of plasmids generally decreases the growth rate, thus possibly allowing for cells with few plasmids to dominate the culture, since they grow faster. The origin of replication also determines the plasmid's compatibility: its ability to replicate in conjunction with another plasmid within the same bacterial cell. Plasmids that utilize the same replication system cannot co-exist in the same bacterial cell. They are said to belong to the same compatibility group. The introduction of a new origin, in the form of a second plasmid from the same compatibility group, mimics the result of replication of the resident plasmid. Thus, any further replication is prevented until after the two plasmids have been segregated to different cells to create the correct pre-replication copy number.

| Origin of Replication | Copy Number | SEQ ID NO. |
|---|---|---|
| pMB1 | 15-20 | 254 |
| p15A | 10-12 | 255 |
| pSC101 | ~5 | 256 |
| pBR322 | 15-20 | 243 |
| ColE1 | 15-20 | 257 |
| pPS10 | 15-20 | 258 |
| RK2 | ~5 | 259 |
| R6K (alpha origin) | 15-20 | 260 |
| R6K (beta origin) | 15-20 | 261 |
| R6K (gamma origin) | 15-20 | 262 |
| P1 (oriR) | Low | 263 |
| R1 | Low | 264 |
| pWSK | Low | 265 |
| ColE2 | 10-15 | 266 |
| pUC (pMB1) | 500-700 | 267 |
| F1 | 300-500 | 268 |

Numerous bacterial origins of replication are known to those of skill in the art, including those listed in the table above. The origin can be selected to achieve a desired copy number. Origins of replication contain sequences that are recognized as initiation sites of plasmid replication via DNA dependent DNA polymerases (del Solar et al. (1998) *Microbiology And Molecular Biology Reviews* 62(2):434-464). Different origins of replication provide for varying plasmid copy levels within each cell and can range from one to hundreds of copies per cell. Commonly used bacterial plasmid origins of replication include, but are not limited to, pMB1 derived origins, which have very high copy derivatives, ColE1 origins, p15A, pSC101, pBR322, and others, which have low copy numbers. Such origins are well known to those of skill in the art. The pUC19 origin results in copy number of 500-700 copies per cell. The pBR322 origin has a known copy number of 15-20. These origins only vary by a single base pair. The ColE1 origin copy number is 15-20, and derivatives such as pBluescript have copy numbers ranging from 300-500. The p15A origin that is in pACYC184, for example, results in a copy number of approximately 10. The pSC101 origins confer a copy number of approximately 5. Other low copy number vectors from which origins can be obtained, include, for example, pWSK29, pWKS30, pWKS129 and pWKS130 (see, Wang et al. (1991) *Gene* 100:195-199). Medium to low copy number is less than 150, or less than 100. Low copy number is less than 20, 25, or 30. Those of skill in the art can identify plasmids with low or high copy number. For example, one way to determine experimentally if the copy number is high or low is to perform a miniprep. A high-copy plasmid should yield between 3-5 μg DNA per 1 ml LB culture; a low-copy plasmid will yield between 0.2-1 μg DNA per ml of LB culture.

Sequences of bacterial plasmids, including identification of and sequence of the origin of replication, are well known (see, e.g., snapgene.com/resources/plasmid_files/basic-_cloning_vectors/pBR322/). High copy plasmids are selected for heterologous expression of proteins in vitro because the gene dosage is increased relative to chromosomal genes and higher specific yields of protein, and for therapeutic bacteria, higher therapeutic dosages of encoded therapeutics. It is shown, herein, however, that for delivery of plasmids encoding therapeutic products by the immunostimulatory bacteria provided herein, a lower copy number is more effective.

The requirement for bacteria to maintain the high copy plasmids can be a problem if the expressed molecule is toxic to the organism. The metabolic requirements for maintaining these plasmids can come at a cost of replicative fitness in vivo. Optimal plasmid copy number for delivery of plasmids encoding therapeutic products can depend on the mechanism of attenuation of the strain engineered to deliver the plasmid. If needed, the skilled person, in view of the disclosure herein, can select an appropriate copy number for a particular immunostimulatory species and strain of bacteria. It is shown herein, that low copy number can be advantageous.

2. Plasmid Maintenance/Selection Components

The maintenance of plasmids in laboratory settings is usually ensured by inclusion of an antibiotic resistance gene on the plasmid and use of antibiotics in growth media. As described above, the use of an asd deletion mutant complimented with a functional asd gene on the plasmid allows for plasmid selection in vitro without the use of antibiotics, and allows for plasmid selection in vivo. The asd gene complementation system provides for such selection (Galan et al. (1990) *Gene* 94(1):29-35). The use of the asd gene complementation system to maintain plasmids in the tumor microenvironment increases the potency of *S. typhimurium* engineered to deliver plasmids encoding therapeutic proteins or interfering RNAs.

3. RNA Polymerase Promoters

In eukaryotic cells, DNA is transcribed by three types of RNA polymerases; RNA Pol I, II and III. RNA Pol I transcribes only ribosomal RNA (rRNA) genes, RNA Pol II transcribes DNA into mRNA and small nuclear RNAs (snRNAs), and RNA Pol III transcribes DNA into ribosomal 5S rRNA (type I), transfer RNA (tRNA) (type II) and other small RNAs such as U6 snRNAs (type III). Prokaryotic promoters, including T7, pBAD and pepT promoters can be utilized when transcription occurs in a bacterial cell (Guo et al. (2011) *Gene therapy* 18:95-105; U.S. Patent Publication Nos. 2012/0009153, 2016/0369282; International Application Publication Nos. WO 2015/032165, WO 2016/025582). Because the bacteria provided herein are designed to deliver the plasmid into tumor-resident immune cells for expression by host cell transcription/translation machinery, the nucleic acids encoding the therapeutic proteins/products, are operatively linked to eukaryotic promoters, such as RNAPII and RNAPIII promoters.

RNA pol III promoters generally are used for constitutive expression. For inducible expression, RNA pol II promoters are used. Examples include the pBAD promoter, which is inducible by L-arabinose; tetracycline-inducible promoters such as TRE-tight, IPT, TRE-CMV, Tet-ON and Tet-OFF; retroviral LTR; IPTG-inducible promoters such as LacI, Lac-O responsive promoters; LoxP-stop-LoxP system promoters (U.S. Pat. No. 8,426,675; International Application Publication No. WO 2016/025582); and pepT, which is a hypoxia-induced promoter (Yu et al. (2012) *Scientific Reports* 2:436). These promoters are well known. Exemplary of these promoters are human U6 (SEQ ID NO:73) and human H1 (SEQ ID NO:74).

| SEQ ID NO. | Name | | Sequence |
|---|---|---|---|
| 73 | human U6 RNA | | aa ggtcgggcag gaagagggcc |
| | pol III | 721 | tatttcccat gattccttca tatttgcata tacgatacaa ggctgttaga gagataatta |
| | promoter | 781 | gaattaattt gactgtaaac acaaagatat tagtacaaaa tacgtgacgt agaaagtaat |
| | | 841 | aatttcttgg gtagtttgca gttttaaaat tatgttttaa aatggactat catatgctta |
| | | 901 | ccgtaacttg aaagtatttc gatttcttgg ctttatatat cttgtggaaa ggacgaaact |
| | | 961 | ag |
| 74 | human H1 RNA | | atatttgca tgtcgctatg |
| | pol III | 721 | tgttctggga aatcaccata aacgtgaaat gtctttggat ttgggaatct tataagttct |
| | promoter | 781 | gtatgagacc actccctagg |

Tissue specific promoters include TRP2 promoter for melanoma cells and melanocytes; MMTV promoter or WAP promoter for breast and breast cancer cells, Villin promoter or FABP promoter for intestinal cells, RIP promoter for pancreatic beta cells, Keratin promoter for keratinocytes, Probasin promoter for prostatic epithelium, Nestin promoter or GFAP promoter for CNS cells/cancers, Tyrosine Hydroxylase S100 promoter or neurofilament promoter for neurons, Clara cell secretory protein promoter for lung cancer, and Alpha myosin promoter in cardiac cells (U.S. Pat. No. 8,426,675). Other promoters for controlling expression of the encoded therapeutic products, such as the gain-of-function variants of proteins that induce type I interferons by increasing expression or rendering it constitutive, include, for example, the EF-1alpha promoter, CMV, SV40, PGK, EIF4A1, CAG, and CD68 promoters.

4. DNA Nuclear Targeting Sequences

DNA nuclear targeting sequences (DTS)s, such as the SV40 DTS, mediate the translocation of DNA sequences through the nuclear pore complex. The mechanism of this transport is reported to be dependent on the binding of DNA binding proteins that contain nuclear localization sequences. The inclusion of a DTS on a plasmid to increase nuclear transport and expression has been demonstrated (see, e.g., Dean, D. A. et al. (1999) *Exp. Cell Res.* 253(2):713-722), and has been used to increase gene expression from plasmids delivered by *S. typhimurium* (see, e.g., Kong et al. (2012) *Proc. Natl. Acad. Sci. U.S.A.* 109(47):19414-19419).

Rho-independent or class I transcriptional terminators such as the T1 terminator of the rrnB gene of *E. coli* contain sequences of DNA that form secondary structures that cause dissociation of the transcription elongation complex. Transcriptional terminators can be included in the plasmid in order to prevent expression of the encoded therapeutic products by the *S. typhimurium* transcriptional machinery. This ensures that expression of the encoded products is confined to the host cell transcriptional machinery.

Plasmids used for transformation of *Salmonella*, such as *S. typhimurium*, as a cancer therapy described herein, contain all or some of the following attributes: 1) a CpG island, 2) a bacterial origin of replication, 3) an asd gene selectable marker for plasmid maintenance, 4) one or more expression cassettes, 5) DNA nuclear targeting sequence(s), and 6) transcriptional terminators.

5. CRISPR

An immunostimulatory bacterium, encoding a CRISPR cassette, can be used to infect human immune, myeloid, or hematopoietic cells in order to site-specifically knockout a target gene of interest. The strain used can be asd$^-$ and can contain a plasmid that lacks the complementary asd cassette and contains a kan cassette. In order to grow the strain in vitro in liquid media, DAP is added to complement the asd$^-$ genetic deficiency. After infection of human cells, the strain can no longer replicate, and the CRISPR cassette-encoded plasmid is delivered. The strain can also be hilA$^-$ or lack one or more parts of the SPI-1, or lack flagellin, or any combination thereof, which reduces or prevents pyroptosis (inflammatory-mediated cell death) of phagocytic cells.

G. OTHER DELIVERY VEHICLES ENCODING THE NON-HUMAN STING PROTEINS AND GAIN-OF-FUNCTION MODIFIED PROTEINS THAT CONSTITUTIVELY INDUCE TYPE I INTERFERON AND OTHER THERAPEUTIC PRODUCTS

As described herein, provided are immunostimulatory bacteria, oncolytic viruses and other delivery vehicles, such as exosomes, liposomes and nanoparticles, that contain nucleic acids encoding therapeutic products, such as proteins that induce, directly or indirectly via pathways, type I interferons (IFNs), including interferon-β and interferon-α. Such proteins include human and non-human STING, and others, such as RIG-1 and MDA5 proteins, and GOF mutants thereof that contain mutations that render their activity constitutive, so that type I interferon is constitutively expressed. Other therapeutic products, such as cytokines and other immunostimulatory proteins, also can be encoded in and/or delivered by these delivery vehicles. The vehicles accumulate in tumor cells or in the tumor microenvironment, such as in tumor-resident immune cells.

1. Exosomes, Extracellular Vesicles, and Other Vesicular Delivery Vehicles

Numerous methods for preparing and using and targeting exosomes and nanoparticles are known to those of skill in the art (see, e.g., Published U.S. Application Nos. 2013/0337066, 2014/0093557, 2018/0104187, 2018/0193266 and 2018/0236104). Exosomes are small, 30-100 nm vesicles secreted by various cell types. They have been adapted as vehicles for the delivery of nucleic acids. They can be targeted to tumors. For example, they can be engineered to express tumor-targeting ligands on their surfaces.

Exosomes are small membrane vesicles of endocytic origin that are released into the extracellular environment following fusion of multivesicular bodies with the plasma membrane. The size of exosomes ranges between 30 and 100 nm in diameter. Their surface consists of a lipid bilayer from the donor cell's cell membrane, and they contain cytosol from the cell that produced the exosome, and exhibit membrane proteins from the parental cell on the surface.

Exosomes are nanoparticles that are secreted endogenously by many types of cells in vitro and in vivo, and commonly can be isolated from body fluids, such as blood, urine and malignant ascites. Exosomes are cup-like multivesicular bodies (MVBs) that can be formed by inward budding and scission of vesicles from the limiting membranes into the endosomal lumen. During the formation of MVBs, transmembrane and peripheral membrane proteins are absorbed into the vesicle membrane, and at the same time, cytosolic components are also embedded in the vesicles. As this process progresses, the MVBs ultimately fuse with the cellular membrane, triggering the release of the exosomes from the cells.

Exosomes exhibit different compositions and functions depending on the cell type from which they are derived. Exosomes are produced by many cells, including epithelial cells, B and T lymphocytes, mast cells (MCs), and dendritic cells (DCs). In humans, exosomes occur in blood plasma, urine, bronchoalveolar lavage fluid, intestinal epithelial cells and tumor tissues. Exosomes have been used to transfer nucleic acids into cells, and can be targeted to any cell in the body, including cells in the immune system. Exosomes can be isolated from cells of different origins, including from cells growing in vitro, and from the human body. They can be produced so that they lack genetic material of their own. Methods for producing exosomes devoid of genetic material are known to those of skill in the art. They include UV-exposure, mutation of proteins that carry RNA into exosomes, electroporation and chemical treatments to open pores in the exosomal membranes. The methods include mutation/deletion of any protein that can modify loading of any nucleic acid into exosomes. Genetic constructs of RNA or DNA can be introduced into exosomes by using conventional molecular biology techniques, such as in vitro transformation, transfection, and microinjection.

Provided herein are exosomes and other extracellular vesicles and other such vehicles containing nucleic acid, DNA or RNA, that encode a gain-of-function modified protein, or that contain the encoded protein, in a cell that leads to constitutive activation of cytosolic IFN signaling pathways/increased sensitivity to cytosolic nucleic acid ligands (e.g., gain-of-function mutations in RIG-I, MIDAS and STING, as described herein). These vehicles can encode additional proteins, such as immunostimulatory proteins that enhance the immune response, including cytokines, for example. The exosomes and other vehicles can be designed to target or accumulate in cells in the tumor microenvironment, including tumor-resident immune cells and tumor cells.

2. Oncolytic Viruses

Oncolytic viruses accumulate and replicate in tumors, which can lead to tumor cell lysis, and immune responses to released tumor antigens and to viral products, resulting in tumor regression. Oncolytic viruses effect treatment by colonizing or accumulating in tumor cells, including metastatic tumor cells, such as circulating tumor cells. Oncolytic viruses can be engineered to encode therapeutic products that are expressed in tumor cells.

Oncolytic viruses include naturally-occurring and engineered recombinant viruses such as, but not limited to, poxvirus, such as vaccinia virus, herpes simplex virus, adenovirus, adeno-associated virus, measles virus, reovirus, vesicular stomatitis virus (VSV), coxsackie virus, Semliki Forest Virus, Seneca Valley Virus, Newcastle Disease Virus, Sendai Virus, Dengue Virus, picornavirus, poliovirus, parvovirus, retrovirus, lentivirus, alphavirus, flavivirus, rhabdovirus, papillomavirus, influenza virus, mumps virus, gibbon ape leukemia virus, and Sindbis virus, among others. In many cases, tumor selectivity is an inherent property of the virus, such as vaccinia viruses and other oncolytic viruses. Oncolytic viruses include, but are not limited to, those known to one of skill in the art and include, for example, vesicular stomatitis virus (see, e.g., U.S. Pat. Nos. 7,731,974, 7,153,510, and 6,653,103; U.S. Patent Publication Nos. 2010/0178684, 2010/0172877, 2010/0113567, 2007/0098743, 2005/0260601, and 2005/0220818; and EP Patent Nos. 1385466, 1606411 and 1520175); herpes simplex virus (see, e.g., U.S. Pat. Nos. 7,897,146, 7,731,952, 7,550,296, 7,537,924, 6,723,316, and 6,428,968; and U.S. Pat. Pub. Nos. 2011/0177032, 2011/0158948, 2010/0092515, 2009/0274728, 2009/0285860, 2009/0215147, 2009/0010889, 2007/0110720, 2006/0039894 and 2004/0009604); retroviruses (see, e.g., U.S. Pat. Nos. 6,689,871, 6,635,472, 6,639,139, 5,851,529, 5,716,826, and 5,716,613; and U.S. Patent Publication No. 2011/0212530); and adeno-associated viruses (see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670). Those of skill in the art know how to grow, select, and modify oncolytic viruses for therapy.

The oncolytic viruses provided herein are modified to encode products that induce expression of type I interferons, such as polypeptides that activate type I interferon pathway signaling and/or NF-κB signaling. These proteins include human and non-human STING, and gain-of-function mutants of STING, and other such proteins, including RIG-I and MDA5, and their gain-of-function mutants, including those described herein. The oncolytic viruses also can encode immunostimulatory proteins, such as cytokines, including interleukin 2 (IL-2). These proteins are under control of a viral promoter or can be under control of other RNA polymerase II promoters. The oncolytic viruses also can encode other therapeutic products, such as RNAi, such as an shRNA or a microRNA that targets a receptor or other target that suppresses immune responses, such as TREX1. The viruses are administered by any suitable methods, including, but not limited to, parenteral administration, such as intravenous, intratumoral and intraperitoneal administration. The viruses can be any known to those of skill in the art, and can encode additional therapeutic products. The viruses can be combined with other therapies suitable for the tumors, such as cisplatin for ovarian tumors, or gemcitabine for pancreatic tumors. Exemplary oncolytic viruses are those discussed below.

a. Adenovirus

Adenoviruses (Ads) are non-enveloped ds-DNA viruses with a linear genome. Human Ads are classified into 57 serotypes (Ad1-Ad57), based on cross-susceptibility, and 7 subgroups (A-G), based on virulence and tissue tropism. Adenovirus serotype 5 (Ad5) is the most commonly used adenovirus for oncolytic virotherapy. Infections in humans are mild and result in cold-like symptoms (Yokoda et al. (2018) *Biomedicines* 6, 33) and systemic administration results in liver tropism and can lead to hepatotoxicity (Yamamoto et al. (2017) *Cancer Sci.* 108:831-837), but Ads are considered safe for therapeutic purposes. Ads enter cells by attaching to the coxsackievirus and adenovirus receptor (CAR), followed by interaction between the αvβ3 and αvβ5 integrins on the cell surface and the Arg-Gly-Asp tripeptide motif (RGD) at the adenoviral penton base (Jiang et al. (2015) *Curr. Opin. Virol.* 13:33-39). CAR is expressed on the surfaces of most normal cells, but expression is highly variable across cancer cell types. On the other hand, RGD-related integrins are highly expressed by cancer cells, but are expressed at much lower levels in normal cells (Jiang et al. (2015)). As a result, adenoviruses can be targeted to cancer cells via the RGD motif.

Ads are attractive as oncolytic viruses due to their high transduction efficiency in transformed cells, their lack of integration into the host genome/lack of insertional mutagenesis, their genomic stability, the ability to insert large therapeutic genes into their genomes, and their capacity for tumor selectivity via genetic manipulation, such as the substitution of viral promoters with cancer tissue-selective promoters (Yokoda et al. (2018) *Biomedicines* 6, 33; Choi et al. (2015) *J. Control. Release* 10(219):181-191).

Examples of oncolytic Ads with tumor-specific promoters include CV706 for prostate cancer treatment, with the adenovirus early region 1A (E1A) gene under control of the prostate specific antigen promoter, and OBP-301, which utilizes the telomerase reverse transcriptase (TERT) promoter for regulation of E1A gene expression (Yamamoto et al. (2017) *Cancer Sci.* 108:831-837). Another method for inducing tumor selectivity is the introduction of mutations in the E1 region of the Ad genome, where the missing genes are functionally complemented by genetic mutations commonly found in tumor cells, such as abnormalities in the retinoblastoma (Rb) pathway or p53 mutations (Yamamoto et al. (2017) *Cancer Sci.* 108:831-837). For example, the oncolytic Ads ONYX-015 and H101 have deletions in the E1B55K gene, which inactivates p53. These mutants cannot block the normal apoptotic defense pathway, resulting in tumor selectivity via the infection of neoplastic cells with defective p53 tumor suppressor pathways (Yamamoto et al. (2017) *Cancer Sci.* 108:831-837; Uusi-Kerttula et al. (2015) *Viruses* 7:6009-6042). E1AΔ24 is an oncolytic Ad that contains a 24-bp mutation in the E1A gene, disrupting the Rb-binding domain and promoting viral replication in cancer cells with Rb pathway mutations. ICOVIR-5 is an oncolytic Ad that combines E1A transcriptional control by the E2F promoter, the Δ24 mutation of E1A and an RGD-4C insertion into the adenoviral fiber (Yamamoto et al. (2017) *Cancer Sci.* 108:831-837; Uusi-Kerttula et al. (2015)). Delta-24-RGD, or DNX-2401, is an oncolytic Ad in which the Δ24 backbone is modified by insertion of the RGD motif, that demonstrated enhanced oncolytic effects in vitro and in vivo (Jiang et al. (2015)).

An alternative strategy for improving tumor selectivity involves overcoming the physical barrier in solid tumors by targeting the extracellular matrix (ECM). For example, an oncolytic Ad that expresses hyaluronidase, such as VCN-01, can be used to facilitate delivery of encoded products and virus throughout the tumor. Ads also have been engineered to express relaxin to disrupt the ECM (Yamamoto et al. (2017) *Cancer Sci.* 108:831-837; Shaw and Suzuki (2016) *Curr. Opin. Virol.* 21:9-15). Ads expressing suicide genes, such as cytosine deaminase (CD) and HSV-1 thymidine kinase (TK) have shown enhanced antitumor efficacy in vivo, as have Ads expressing immunostimulatory cytokines, such as ONCOS-102, which expresses GM-CSF (Yamamoto et al. (2017) *Cancer Sci.* 108:831-837; Shaw and Suzuki (2016) *Curr. Opin. Virol.* 21:9-15). A Δ24-based oncolytic Ad expressing an anti-CTLA4 antibody has shown promise in preclinical studies (Jiang et al. (2015)).

The adenovirus H101 (available under the brand name Oncorine) was the first oncolytic Ad approved for clinical use in China in combination with chemotherapy, for treating patients with advanced nasopharyngeal cancer in 2005. Clinical trials have demonstrated the use of oncolytic adenoviruses for the treatment of a wide variety of cancers. For example, there have been and are clinical trials of: an oncolytic Ad5 encoding IL-12 in patients with metastatic pancreatic cancer (NCT03281382); an immunostimulatory Ad5 (LOAd703) expressing TMX-CD40L and 41BBL in patients with pancreatic adenocarcinoma, ovarian cancer, biliary carcinoma and colorectal cancer (NCT03225989); LOAd703 in combination with gemcitabine and nab-paclitaxel in patients with pancreatic cancer (NCT02705196); an oncolytic adenovirus encoding human PH20 hyaluronidase (VCN-01) in combination with gemcitabine and Abraxane® chemotherapy in patients with advanced solid tumors, including pancreatic adenocarcinoma (NCT02045602; NCT02045589); Telomelysin® (OBP-301), which is an oncolytic adenovirus with tumor selectivity, and containing the human telomerase reverse transcriptase (hTERT) promoter, in patients with hepatocellular carcinoma (NCT02293850); an E1B gene deleted Ad5 in combination with transarterial chemoembolization (TACE) in patients with hepatocellular carcinoma (NCT01869088); CG0070, an oncolytic Ad that expresses GM-CSF and contains the cancer-specific E2F-1 promoter to drive expression of E1A, in patients with bladder cancer (NCT02365818; NCT01438112); Enadenotucirev (Colo-Ad1), an Ad11p/Ad3 chimeric Group B oncolytic virus, in patients with colon cancer, non-small cell lung cancer, bladder cancer and renal cell carcinoma (NCT02053220); and DNX-2401 (Ad5 E1AΔ24RGD) in combination with Temozolomide (NCT01956734), or in combination with IFNγ (NCT02197169) in patients with glioblastoma.

b. Herpes Simplex Virus

Herpes simplex virus (HSV) belongs to the family Herpesviridae and has a large linear double-stranded DNA genome, including many genes that are nonessential for viral replication, making it an ideal candidate for genetic manipulation. Other advantages include its ability to infect a broad range of cell types, its sensitivity to antivirals such as acyclovir and ganciclovir, and its lack of insertional mutagenesis (Sokolowski et al. (2015) *Oncolytic Virotherapy* 4:207-219; Yin et al. (2017) *Front. Oncol.* 7:136). There are two types of HSV, HSV type I (HSV-1) and type II (HSV-2), with the majority of oncolytic HSVs being derived from HSV-1. In humans, HSV-1 causes fever blister disease and infects epithelial cells, neurons, and immune cells by binding to nectins, glycoproteins, and the herpesvirus entry mediator (HVEM) on the cell surface (Kohlhapp and Kaufman (2016) *Clin. Cancer Res.* 22(5):1048-1054).

Many different oncolytic HSV-1 viruses have been generated to date. Any can be further modified to encode the modified DNA/RNA gain-of-function proteins, as described herein, so that upon accumulation in tumors and the tumor microenvironment, the HSVs that are so-modified, express the encoded protein to constitutively express immune response mediators, such as a type I interferon. For example, HSV-1 has been engineered to express the anti-HER-2 antibody trastuzumab, targeting tumors that overexpress HER-2, such as breast and ovarian cancers, gastric carcinomas and glioblastomas. The gene encoding trastuzumab was inserted into two regions within the HSV-1 gD glycoprotein gene, generating two oncolytic HSVs, R-LM113 and R-LM249. R-LM113 and R-LM249 demonstrated preclinical activity against human breast and ovarian cancers, and against a murine model of HER2+ glioblastoma. Another oncolytic HSV-1, dlsptk HSV-1, contains a deletion in the unique long 23 (UL23) gene, which encodes the viral homologue of thymidine kinase (TK), while the hrR3 HSV-1 mutant contains a LacZ insertion mutation of the large subunit of ribonucleotide reductase (RR), also known as ICP6, encoded by the gene UL39. As a result, dlsptk and hrR3 HSV-1 mutants can only replicate in cancer cells that overexpress TK and RR, respectively (Sokolowski et al. (2015) *Oncolytic Virotherapy* 4:207-219).

HF10 is a spontaneously mutated oncolytic HSV-1 that lacks the genes encoding UL43, UL49.5, UL55, UL56 and latency-associated transcripts, and overexpresses UL53 and UL54. HF10 has shown promising results in preclinical studies and demonstrated high tumor selectivity, high viral replication, potent antitumor activity and a favorable safety profile (Eissa et al. (2017) *Front. Oncol.* 7:149). Clinical trials investigating HF10 include: a phase I study in patients with refractory head and neck cancer, squamous cell carcinoma of the skin, carcinoma of the breast and malignant melanoma (NCT01017185), and a Phase I study of HF10 in combination with chemotherapy (gemcitabine, Nab-paclitaxel, TS-1) in patients with unresectable pancreatic cancer (NCT03252808). HF10 also has been combined with the anti-CTLA-4 antibody ipilimumab, resulting in improved therapeutic efficacy in patients with stage IIIb, IIIc or IV unresectable or metastatic melanoma (NCT03153085). A phase II clinical study is investigating the combination of HF10 with the anti-PD-1 antibody Nivolumab in patients with resectable stage IIIb, IIIc and IV melanoma (NCT03259425) and in combination with ipilimumab in patients with unresectable or metastatic melanoma (NCT02272855). Paclitaxel and HF10 combination therapy resulted in superior survival rates in peritoneal colorectal cancer models compared with either treatment alone, while combination treatment with HF10 and erlotinib resulted in improved activity against pancreatic xenografts in vitro and in vivo over either HF10 or erlotinib alone (Eissa et al. (2017) *Front. Oncol.* 7:149).

Talimogene laherparepvec (available under the trademark Imlygic®, T-VEC), previously known as OncoVEX$^{GM-CSF}$, is an FDA-approved oncolytic herpes simplex virus for the treatment of advanced melanoma, that was generated from the JS1 strain of HSV-1 and genetically engineered to express granulocyte macrophage stimulating factor (GM-CSF; Aref et al. (2016) *Viruses* 8:294). In T-VEC, GM-CSF expression enhances the antitumor cytotoxic immune response, while deletion of both copies of the infected cell protein 34.5 (ICP34.5) gene suppresses replication in normal tissues, and deletion of the ICP47 gene increases expression of MHC class I molecules, allowing for antigen presentation on infected cells (Eissa et al. (2017)). T-VEC exhibits tumor selectivity by binding to nectins on the surface of cancer cells and preferentially replicates in tumor cells by exploiting disrupted oncogenic and antiviral signaling pathways, particularly the protein kinase R (PKR) and type I IFN pathways. In normal cells, PKR is activated by viral infection, which then phosphorylates the eukaryotic initiation factor-2A protein (eIF-2A), inactivating it and in turn, inhibiting cellular protein synthesis, blocking cell proliferation and preventing viral replication. Wild-type HSV escapes the antiviral response due to expression of the ICP34.5 protein, which activates a phosphatase that dephosphorylates eIF-2A, restoring protein synthesis in the infected cells. Thus, deletion of ICP34.5 precludes viral replication of T-VEC in normal cells. The PKR-eIF-2A pathway in cancer cells, however, is disrupted, permitting continuous cell growth and uninhibited viral replication (Kohlhapp and Kaufman (2016) *Clin. Cancer Res.* 22 (5): 1048-1054; Yin et al. (2017) *Front. Oncol.* 7:136). The expression of GM-CSF improves the immunogenicity of T-VEC by causing dendritic cell accumulation, promoting antigen-presentation and priming T-cell responses (Kohlhapp and Kaufman (2016) *Clin. Cancer Res.* 22 (5): 1048-1054).

T-VEC has shown preferential replication in a variety of different cancer cell lines, including breast cancer, colorectal adenocarcinoma, melanoma, prostate cancer, and glioblastoma. Clinical trials include, for example, those investigating T-VEC in pancreatic cancer (NCT03086642, NCT00402025), recurrent breast cancer (NCT02658812), advanced non-CNS tumors in children (NCT02756845), non-melanoma skin cancer (NCT03458117), non-muscle invasive bladder transitional cell carcinoma (NCT03430687), and malignant melanoma (NCT03064763), as well as T-VEC in combination with atezolizumab in patients with metastatic triple negative breast cancer and metastatic colorectal cancer with liver metastases (NCT03256344), in combination with paclitaxel in patients with triple negative breast cancer (NCT02779855), in combination with nivolumab in patients with refractory lymphomas or advanced/refractory non-melanoma skin cancers (NCT02978625), in combination with cisplatin and radiotherapy in patients with advanced head and neck cancer (NCT01161498), and in combination with pembrolizumab in patients with liver tumors (NCT02509507), carcinoma of the head and neck (NCT02626000), sarcoma (NCT03069378) and melanoma (NCT02965716, NCT02263508).

In addition to GM-CSF, numerous other immune stimulating genes have been inserted into oncolytic HSVs, including those encoding IL-12, IL-15, IL-18, TNFα, IFNα/β and fms-like tyrosine kinase 3 ligand, resulting in increased therapeutic efficacy (Sokolowski et al. (2015); Yin et al. (2017)).

Another oncolytic HSV-1, R3616 contains deletions in both copies of the RL1 (also known as γ134.5) gene, which encodes ICP34.5, targeting cancer cells with disrupted PKR pathways. NV1020 (or R7020) is an HSV-1 mutant that contains deletions in the UL55, UL56, ICP4, RL1 and RL2 genes, resulting in reduced neurovirulence and cancer selectivity. NV1020 displayed promising results in murine models of head and neck squamous cell carcinoma, epidermoid carcinoma and prostrate adenocarcinoma (Sokolowski et al. (2015)). Additionally, clinical trials have investigated the safety and efficacy of NV1020 in colorectal cancer metastatic to the liver (NCT00149396 and NCT00012155).

G207 (or MGH-1) is another HSV-1 mutant with an RL1 (γ134.5) deletion and a LacZ inactivating insertion in the UL39 neurovirulence gene. Clinical studies utilizing G207 include the investigation of G207 administration alone or with a single radiation dose in children with progressive or recurrent supratentorial brain tumors (NCT02457845), the investigation of the safety and efficacy of G207 in patients with recurrent brain cancer (glioma, astrocytoma, glioblastoma) (NCT00028158), and the investigation of the effects of G207 administration followed by radiation therapy in patients with malignant glioma (NCT00157703).

G207 was used to generate G474, which contains a further deletion in the gene encoding ICP47. Other HSV-1 derived oncolytic viruses include HSV1716, which contains deletions in RL1, but has an intact UL39 gene and replicates selectively in actively dividing cells, and the KM100 mutant, which has insertions in the UL48 and RL2 genes, resulting in a loss of expression of immediate early viral genes and cancer cell selectivity (Sokolowski et al. (2015); Yin et al. (2017) *Front. Oncol.* 7:136).

Oncolytic viruses also have been derived from HSV-2. For example, FusOn-H2 is an HSV-2 oncolytic virus with a deletion of the N-terminal region of the ICP10 gene that encodes a serine/threonine protein kinase (PK) domain. This PK is responsible for phosphorylating GTPase-activating protein Ras-FAP, which activates the Ras/MEK/MAPK mitogenic pathway and induces and stabilizes c-Fos, which is required for efficient HSV-2 replication. Normal cells usually have an inactivated Ras signaling pathway. Thus, FusOn-H2 exhibits tumor selectivity by replicating only in tumor cells with activated Ras signaling pathways (Fu et al. (2006) *Clin. Cancer Res.* 12(10):3152-3157). FusOn-H2 has demonstrated activity against pancreatic cancer xenografts (Fu et al. (2006) *Clin. Cancer Res.* 12(10):3152-3157), against Lewis lung carcinoma xenografts in combination with cyclophosphamide, and against syngeneic murine mammary tumors and neuroblastoma (Li et al. (2007) *Cancer Res.* 67:7850-7855).

c. Poxvirus

Vaccinia viruses are exemplary of poxviruses. Vaccinia is a cytoplasmic virus, thus, it does not insert its genome into the host genome during its life cycle. Vaccinia virus has a linear, double-stranded DNA genome of approximately 180,000 base pairs in length that is made up of a single continuous polynucleotide chain (Baroudy et al. (1982) *Cell* 28:315-324). The structure is due to the presence of 10,000 base pair inverted terminal repeats (ITRs). The ITRs are involved in genome replication. Genome replication involves self-priming, leading to the formation of high molecular weight concatemers (isolated from infected cells), which subsequently are cleaved and repaired to make virus genomes (see, e.g., Traktman, P., Chapter 27, Poxvirus DNA Replication, pp. 775-798, in DNA Replication in Eukaryotic Cells, Cold Spring Harbor Laboratory Press (1996)). The genome contains approximately 250 genes. In general, the non-segmented, non-infectious genome is arranged such that centrally located genes are essential for virus replication (and are thus conserved), while genes near the two termini effect more peripheral functions such as host range and virulence. Vaccinia viruses practice differential gene expression by utilizing open reading frames (ORFs) arranged in sets that, as a general principle, do not overlap.

Vaccinia virus possesses a variety of features for use in cancer gene therapy and vaccination, including broad host and cell type range, and low toxicity. For example, while most oncolytic viruses are natural pathogens, vaccinia virus has a unique history in its widespread application as a smallpox vaccine that has resulted in an established track record of safety in humans. Toxicities related to vaccinia administration occur in less than 0.1% of cases, and can be effectively addressed with immunoglobulin administration. In addition, vaccinia virus possesses a large carrying capacity for foreign genes (up to 25 kb of exogenous DNA fragments, approximately 12% of the vaccinia genome size, can be inserted into the vaccinia genome) and high sequence homology among different strains for designing and generating modified viruses in other strains. Techniques for production of modified vaccinia strains by genetic engineering are well established (Moss (1993) *Curr. Opin. Genet. Dev.* 3: 86-90; Broder and Earl (1999) *Mol. Biotechnol.* 13: 223-245; Timiryasova et al. (2001) *Biotechniques* 31: 534-540). Vaccinia virus strains have been shown to specifically colonize solid tumors, while not infecting other organs (see, e.g., Zhang et al. (2007) *Cancer Res.* 67:10038-10046; Yu et al. (2004) *Nat. Biotech.* 22:313-320; Heo et al. (2011)*Mol. Ther.* 19:1170-1179; Liu et al. (2008) *Mol. Ther.* 16:1637-1642; Park et al. (2008) *Lancet Oncol.* 9:533-542).

Examples of vaccinia viruses include, but are not limited to, Lister (also known as Elstree), New York City Board of Health (NYCBH), Dairen, Ikeda, LC16M8, Western Reserve (WR), Copenhagen (Cop), Tashkent, Tian Tan, Wyeth, Dryvax, IHD-J, IHD-W, Brighton, Ankara, Modified Vaccinia Ankara (MVA), Dairen I, LIPV, LC16M0, LIVP, WR 65-16, EM63, Bern, Paris, CVA382, NYVAC, ACAM2000 and Connaught strains. Vaccinia viruses are oncolytic viruses that possess a variety of features that make them particularly suitable for use in wound and cancer gene therapy. For example, vaccinia is a cytoplasmic virus, thus, it does not insert its genome into the host genome during its life cycle. Unlike many other viruses that require the host's transcription machinery, vaccinia virus can support its own gene expression in the host cell cytoplasm using enzymes encoded in the viral genome. Vaccinia viruses also have a broad host and cell type range. In particular, vaccinia viruses can accumulate in immunoprivileged cells or immunoprivileged tissues, including tumors and/or metastases, and also including wounded tissues and cells. Yet, unlike other oncolytic viruses, vaccinia virus can typically be cleared from the subject to whom the viruses are administered by activity of the subject's immune system, and hence are less toxic than other viruses such as adenoviruses. Thus, while the viruses can typically be cleared from the subject to whom the viruses are administered by activity of the subject's immune system, viruses can nevertheless accumulate, survive and proliferate in immunoprivileged cells and tissues such as tumors, because such immunoprivileged areas are isolated from the host's immune system.

Vaccinia viruses also can be easily modified by insertion of heterologous genes. This can result in the attenuation of the virus and/or permit delivery of therapeutic proteins. For example, the vaccinia virus genome has a large carrying capacity for foreign genes, where up to 25 kb of exogenous DNA fragments (approximately 12% of the vaccinia genome size) can be inserted. The genomes of several of the vaccinia strains have been completely sequenced, and many essential and nonessential genes identified. Due to high sequence homology among different strains, genomic information from one vaccinia strain can be used for designing and generating modified viruses in other strains. Finally, the techniques for production of modified vaccinia strains by genetic engineering are well established (Moss (1993) *Curr. Opin. Genet. Dev.* 3:86-90; Broder and Earl (1999) *Mol. Biotechnol.* 13:223-245; Timiryasova et al. (2001) *Biotechniques* 31:534-540).

Various vaccinia viruses have been demonstrated to exhibit antitumor activities. In one study, for example, nude mice bearing non-metastatic colon adenocarcinoma cells were systemically injected with a WR strain of vaccinia virus modified by having a vaccinia growth factor deletion and an enhanced green fluorescent protein inserted into the thymidine kinase locus. The virus was observed to have antitumor effects, including one complete response, despite a lack of exogenous therapeutic genes in the modified virus (McCart et al. (2001) *Cancer Res.* 1:8751-8757). In another study, vaccinia melanoma oncolysate (VMO) was injected into sites near melanoma positive lymph nodes in a Phase III clinical trial of melanoma patients. As a control, a New York City Board of Health strain vaccinia virus (VV) was administered to melanoma patients. The melanoma patients treated with VMO had a survival rate better than that for untreated patients, but similar to patients treated with the VV control (Kim et al. (2001) *Surgical Oncol.* 10:53-59).

LIVP strains of vaccinia virus also have been used for the diagnosis and therapy of tumors, and for the treatment of wounded and inflamed tissues and cells (see, e.g., Lin et al. (2007) *Surgery* 142:976-983; Lin et al. (2008) *J. Clin. Endocrinol. Metab.* 93:4403-7; Kelly et al. (2008) *Hum. Gene Ther.* 19:774-782; Yu et al. (2009) *Mol. Cancer Ther.* 8:141-151; Yu et al. (2009) *Mol. Cancer* 8:45; U.S. Pat. Nos. 7,588,767; 8,052,968; and U.S. Publication No. 2004/0234455). For example, when intravenously administered, LIVP strains have been demonstrated to accumulate in internal tumors at various loci in vivo, and have been demonstrated to effectively treat human tumors of various tissue origin, including, but not limited to, breast tumors, thyroid tumors, pancreatic tumors, metastatic tumors of pleural mesothelioma, squamous cell carcinoma, lung carcinoma and ovarian tumors. LIVP strains of vaccinia, including attenuated forms thereof, exhibit less toxicity than WR strains of vaccinia virus, and result in increased and longer survival of treated tumor-bearing animal models (see, e.g., U.S. Publication No. 2011/0293527).

d. Measles Virus

Measles virus (MV) is an enveloped, single-stranded RNA virus with a negative-sense genome that belongs to the family of Paramyxoviruses. Its non-segmented genome is stable, with a low risk of mutating and reverting to its pathogenic form, and due to its replication in the cytoplasm, poses no risk of insertional DNA mutagenesis in infected cells. MV was first isolated from a patient called Edmonston in 1954, and developed into a live vaccine with an excellent safety profile, that has successfully protected over a billion individuals worldwide for 50 years, by attenuation following multiple in vitro passages (Aref et al. (2016) *Viruses* 8:294; Hutzen et al. (2015) *Oncolytic Virotherapy* 4:109-118). Derivatives of this strain, denoted as MV-Edm, are the most commonly utilized MV strains in oncolytic therapy studies. The Schwarz/Moraten measles vaccine strain is more attenuated and immunogenic than Edm derivatives, which makes it safer and more immunomodulatory (Veinalde et al. (2017) *Oncoimmunology* 6(4):e1285992). The oncolytic effects of wildtype MV were documented in the 1970s, with reports of improvements in patients with acute lymphoblastic leukemia, Burkitt's lymphoma and Hodgkin's lymphoma (Aref et al. (2016)).

MV uses three main receptors for entry into target cells: CD46, nectin-4 and signaling lymphocyte activation molecule (SLAM) (Aref et al. (2016); Hutzen et al. (2015)). Whereas SLAM, which is expressed on activated B and T cells, immature thymocytes, monocytes and dendritic cells, is the main receptor for wildtype strains, attenuated and tumor-selective MV-Edm strains primarily target the CD46 receptor, a regulator of complement activation that is overexpressed in many tumor cells (Aref et al. (2016); Hutzen et al. (2015); Jacobson et al. (2017) *Oncotarget* 8(38):63096-63109; Msaouel et al. (2013) *Expert Opin. Biol. Ther.* 13(4):483-502). Nectin-4, which is predominantly expressed in the respiratory epithelium, is utilized by both wild-type and attenuated MV strains (Aref et al. (2016); Msaouel et al. (2013) *Expert Opin. Biol. Ther.* 13(4):483-502). As with other oncolytic viruses, defects in the IFN antiviral response of tumor cells also facilitates the tumor-selectivity of MV (Aref et al. (2016); Jacobson et al. (2017) *Oncotarget* 8(38):63096-63109). Clinical trials investigating MV in the treatment of several cancers, including multiple myeloma (NCT02192775, NCT00450814), head and neck cancer (NCT01846091), mesothelioma (NCT01503177), and ovarian cancer (NCT00408590, NCT02364713) have been conducted.

MV has been genetically engineered to express immune-stimulating and immunomodulatory genes, including those encoding IL-13, IFN-beta, GM-CSF and *Helicobacter pylori* neutrophil-activating protein (NAP), for example (Aref et al. (2016), Hutzen et al. (2015); Msaouel et al. (2013) *Expert Opin. Biol. Ther.* 13(4):483-502). Combination therapies utilizing oncolytic MV with anti-CTLA-4 and anti-PD-L1 antibodies have been effective in melanoma mouse models (Aref et al. (2016); Hutzen et al. (2015)).

MV-CEA, which is genetically engineered to express the tumor marker carcinoembryonic antigen (CEA), results in the release of CEA into the blood stream of patients following infection of cancer cells, allowing the detection of CEA levels and thus, the tracking of in vivo viral infection (Aref et al. (2016); Hutzen et al. (2015)). The therapeutic use of MV-CEA has been demonstrated pre-clinically, and is in Phase I clinical trials for the treatment of ovarian cancer (NCT00408590).

e. Reovirus

Respiratory Enteric Orphan virus, commonly known as Reovirus, is a non-enveloped double-stranded RNA virus of the Reoviridae family that is nonpathogenic to humans. Wild-type reovirus is ubiquitous throughout the environment, resulting in a 70-100% seropositivity in the general population (Gong et al. (2016) *World J. Methodol.* 6(1):25-42). There are three serotypes of reovirus, which include type 1 Lang, type 2 Jones, type 3 Abney and type 3 Dearing (T3D). T3D is the most commonly used naturally occurring oncolytic reovirus serotype in pre-clinical and clinical studies.

Oncolytic reovirus is tumor-selective due to activated Ras signaling that is characteristic of cancer cells (Gong et al. (2016); Zhao et al. (2016) *Mol. Cancer Ther.* 15(5):767-773). Activation of the Ras signaling pathway disrupts the cell's anti-viral responses, by inhibiting the phosphorylation of dsRNA-dependent protein kinase (PKR), a protein that is normally responsible for preventing viral protein synthesis (Zhao et al. (2016)). Ras activation also enhances viral un-coating and disassembly, results in enhanced viral progeny generation and infectivity, and accelerates the release of progeny through enhanced apoptosis (Zhao et al. (2016)). It is estimated that approximately 30% of all human tumors display aberrant Ras signaling (Zhao et al. (2016)). For example, the majority of malignant gliomas possess activated Ras signaling pathways, with reovirus demonstrating antitumor activity in 83% of malignant glioma cells in vitro, as well as in vivo in human malignant glioma models, and in 100% of glioma specimens ex vivo (Gong et al. (2016) *World J. Methodol.* 6(1):25-42). Additionally, pancreatic adenocarcinomas display a very high incidence of Ras mutations (approximately 90%), and reovirus has shown potent cytotoxicity in 100% of pancreatic cell lines tested in vitro, and induced regression in 100% of subcutaneous tumor mouse models in vivo (Gong et al. (2016)).

Reovirus has demonstrated broad anticancer activity pre-clinically across a spectrum of malignancies including colon, breast, ovarian, lung, skin (melanoma), neurological, hematological, prostate, bladder, and head and neck cancers (Gong et al. (2016)). Reovirus therapy has been tested in combination with radiotherapy, chemotherapy, immunotherapy, and surgery. The combination of reovirus and radiation therapy has proven beneficial in the treatment of head and neck, colorectal and breast cancer cell lines in vitro, as well as colorectal cancer and melanoma models in vivo (Gong et al. (2016)). The combination of reovirus and gemcitabine, as well as reovirus, paclitaxel and cisplatin, have proven successful in mouse tumor models (Zhao et al. (2016)). Preclinical studies in B16 melanoma mouse models have shown that the combination of oncolytic reovirus and anti-PD-1 therapy demonstrated improved anticancer efficacy in comparison to reovirus alone (Gong et al. (2016); Zhao et al. (2016); Kemp et al. (2015) *Viruses* 8, 4).

The promising pre-clinical results demonstrated by reovirus have led to many clinical trials. Reolysin® reovirus, developed by the Canadian company Oncolytics Biotech Inc., is the only therapeutic wild-type reovirus in clinical development, and has demonstrated anticancer activity in many malignancies alone, and in combination with other therapeutics. For example, a phase I clinical study of the Reolysin® reovirus in the treatment of recurrent malignant gliomas (NCT00528684) found that the reovirus was well tolerated, while a phase I/II trial found that Reolysin® reovirus kills tumor cells without damaging normal cells in patients with ovarian epithelial cancer, primary peritoneal cancer, or fallopian tube cancer that did not respond to platinum chemotherapy (NCT00602277). A phase II clinical trial of Reolysin® reovirus demonstrated safety and efficacy in the treatment of patients with bone and soft tissue sarcomas metastatic to the lung (NCT00503295). A phase I clinical trial of Reolysin® reovirus in combination with FOLFIRI and bevacizumab in patients with metastatic colorectal cancer (NCT01274624) has been conducted. A phase II clinical trial of Reolysin® reovirus in combination with the chemotherapeutic gemcitabine was carried out in patients with advanced pancreatic adenocarcinoma (NCT00998322), a phase II clinical study investigated the therapeutic potential of Reolysin® reovirus in combination with docetaxel in metastatic castration resistant prostate cancer (NCT01619813), and a phase II clinical trial investigated the combination of Reolysin® reovirus with paclitaxel in patients with advanced/metastatic breast cancer (NCT01656538). A phase III clinical trial investigated the efficacy of Reolysin® reovirus in combination with paclitaxel and carboplatin in platinum-refractory head and neck cancers (NCT01166542), while phase II clinical studies employing this combination therapy were carried out in patients with non-small cell lung cancer (NCT00861627) and metastatic melanoma (NCT00984464). A phase I clinical trial of Reolysin® reovirus in combination with carfilzomib and dexamethasone in patients with relapsed or refractory multiple myeloma is ongoing (NCT02101944).

f. Vesicular Stomatitis Virus (VSV)

Vesicular stomatitis virus (VSV) is a member of the Vesiculovirus genus within the Rhabdoviridae family. Its genome, which consists of a single-stranded RNA with negative-sense polarity, consists of 11,161 nucleotides and encodes for five genes: nucleocapsid protein (N), phosphoprotein (P), matrix protein (M), glycoprotein (G), and large polymerase protein (Bishnoi et al. (2018) *Viruses* 10(2), 90). VSV is transmitted by insect vectors and disease is limited to its natural hosts, including horses, cattle, and pigs, with mild and asymptomatic infection in humans (Bishnoi et al. (2018) *Viruses* 10(2), 90). VSV is a potent and rapid inducer of apoptosis in infected cells, and has been shown to sensitize chemotherapy-resistant tumor cells. VSV has been shown to infect tumor vasculature, resulting in a loss of blood flow to the tumor, blood-coagulation, and lysis of neovasculature. This virus also is capable of replication and induction of cytopathic effects and cell lysis in hypoxic tissues. In addition, WT VSV grows to high titers in a variety of tissue culture cells lines, facilitating large-scale virus production, it has a small and easy to manipulate genome, and it replicates in the cytoplasm without risk of host cell transformation (Bishnoi et al. (2018); Felt and Grdzelishvili (2017) *Journal of General Virology* 98:2895-2911). These factors, together with the fact that it is not pathogenic to humans and there is generally no pre-existing human immunity to VSV, make it a good candidate for viral oncotherapy.

Although VSV can attach to ubiquitously expressed cell-surface molecules, making it "pantropic," WT VSV is sensitive to type I IFN responses and thus displays oncoselectivity based on the defective or inhibited type I IFN signaling of tumors (Felt and Grdzelishvili (2017)). Due to its infectivity of normal cells, VSV can cause neuropathogenicity, but can be attenuated by modifying its matrix protein and/or glycoprotein. For example, the matrix protein can be deleted or the methionine residue at position 51 of the matrix protein can be deleted or substituted with arginine (Bishnoi et al. (2018); Felt and Grdzelishvili (2017)). Another approach replaces the glycoprotein of VSV with that of lymphocytic choriomeningitis virus (LCMV) (rVSV-GP) (Bishnoi et al. (2018); Felt and Grdzelishvili (2017)). VSV also can be genetically modified to include suicide genes, such as herpes virus thymidine kinase (TK), or to express immune-stimulatory cytokines such as IL-4, IL-12, and IFNβ, or co-stimulatory agents such as granulocyte-macrophage-colony-stimulating factor 1 (GM-CSF1), to enhance oncolytic activity (Bishnoi et al. (2018)). VSV-IFNβ-sodium iodide symporter (VSV-IFNβ-NIS), which encodes NIS and IFNβ, is being tested in the USA in several phase I clinical trials (see details at ClinicalTrials.gov for trials NCT02923466, NCT03120624 and NCT03017820).

Vesicular stomatitis virus (VSV) is an effective oncolytic therapeutic when administered intravenously (IV) in a variety of murine cancer models. In one study, rVSV-GP was successful in the intratumoral treatment of subcutaneously engrafted G62 human glioblastoma cells, as well as the intravenous treatment of orthotopic U87 human glioma cells, in immune-deficient mouse models. Intratumoral injection of rVSV-GP also was effective against intracranial CT2A murine glioma cells (Muik et al. (2014) *Cancer Res.* 74(13):3567-3578). It was found that rVSV-GP did not elicit a detectable neutralizing antibody response, and that this genetically modified oncolytic virus was insensitive to human complement, remaining stable over the length of the experiment (Muik et al. (2014)). In another example, intratumoral administration of rVSV-GP was found to effectively infect and kill human A375 malignant melanoma cells transplanted in a mouse model, as well as the murine B16 melanoma cell line (Kimpel et al. (2018) *Viruses* 10, 108). Intravenous injection of the oncolytic virus was not successful, and even in the intratumorally-administered groups, the tumors all eventually grew, due to type I IFN responses (Kimpel et al. (2018)). In another study, a subcutaneous xenograft mouse model with A2780 human ovarian cancer cells was treated with intratumoral injection of rVSV-GP, and although tumor remission was initially observed with no neurotoxicity, remission was temporary and the tumors recurred. This was found to be due to type I IFN responses, with an observed reversal of the antiviral state by combining rVSV-GP with the JAK1/2 inhibitor ruxolitinib (Dold et al. (2016) *Molecular Therapy—Oncolytics* 3, 16021).

g. Newcastle Disease Virus

Newcastle Disease Virus (NDV) is an avian paramyxovirus with a single-stranded RNA genome of negative polarity that infects poultry and is generally nonpathogenic to humans, but can cause flu-like symptoms (Tayeb et al. (2015) *Oncolytic Virotherapy* 4:49-62; Cheng et al. (2016) *J. Virol.* 90:5343-5352). Due to its cytoplasmic replication, lack of host genome integration and recombination, and high genomic stability, NDV and other paramyxoviruses provide safer and more attractive alternatives to other oncolytic viruses, such as retroviruses or some DNA viruses (Matveeva et al. (2015) *Molecular Therapy—Oncolytics* 2, 150017). NDV has been shown to demonstrate tumor selectivity, with 10,000 times greater replication in tumor cells than normal cells, resulting in oncolysis due to direct cytopathic effects and induction of immune responses (Tayeb et al. (2015); Lam et al. (2011) *Journal of Biomedicine and Biotechnology*, Article ID: 718710). Though the mechanism of NDV's tumor selectivity is not entirely clear, defective interferon production and responses to IFN signaling in tumor cells allow the virus to replicate and spread (Cheng et al. (2016); Ginting et al. (2017) *Oncolytic Virotherapy* 6:21-30). The high affinity of paramyxoviruses towards cancer cells can also be due to overexpression of viral receptors on cancer cell surfaces, including sialic acid (Cheng et al. (2016); Matveeva et al. (2015); Tayeb et al. (2015)).

Non-engineered NDV strains are classified as lentogenic (avirulent), mesogenic (intermediate), or velogenic (virulent), based on their pathogenicity in chickens, with velogenic and mesogenic strains being capable of replication in (and lysis of) multiple human cancer cell lines, but not lentogenic strains (Cheng et al. (2016); Matveeva et al. (2015)). NDV strains also are categorized as lytic or non-lytic, with only the lytic strains being able to produce viable and infectious progeny (Ginting et al. (2017); Matveeva et al. (2015)). On the other hand, the oncolytic effects of non-lytic strains stems mainly from their ability to stimulate immune responses that result in antitumor activity (Ginting et al. (2017) *Oncolytic Virotherapy* 6:21-30). Mesogenic lytic strains commonly utilized in oncotherapy include PV701 (MK107), MTH-68/H and 73-T, and lentogenic non-lytic strains commonly utilized include HUJ, Ulster and Hitchner-B1 (Tayeb et al. (2015); Lam et al. (2011); Freeman et al. (2006) *Mol. Ther.* 13(1):221-228).

The NDV strain PV701 displayed activity against colorectal cancer in a phase 1 trial (Laurie et al. (2006) *Clin. Cancer Res.* 12(8):2555-2562), and NDV strain 73-T demonstrated in vitro oncolytic activity against various human cancer cell lines, including fibrosarcoma, osteosarcoma, neuroblastoma and cervical carcinoma, as well as in vivo therapeutic effects in mice bearing human neuroblastomas, fibrosarcoma xenografts and several carcinoma xenografts, including colon, lung, breast and prostate cancer xenografts (Lam et al. (2011)). NDV strain MTH-68/H resulted in significant regression of tumor cell lines, including PC12, MCF7, HCT116, DU-145, HT-29, A431, HELA, and PC3 cells, and demonstrated favorable responses in patients with advanced cancers when administered by inhalation (Lam et al. (2011)). The non-lytic strain Ulster demonstrated cytotoxic effects against colon carcinoma, while the lytic strain Italien effectively killed human melanomas (Lam et al. (2011)). Lentogenic NDV strain HUJ demonstrated oncolytic activity against recurrent gliobastoma multiforme when administered intravenously to patients, while lentogenic strain LaSota prolonged survival in colorectal cancer patients (Lam et al. (2011); Freeman et al. (2006) *Mol. Ther.* 13(1):221-228) and was capable of infecting and killing non-small cell lung carcinoma (A549), glioblastoma (U87MG and T98G), mammary gland adenocarcinoma (MCF7 and MDA-MB-453) and hepatocellular carcinoma (Huh7) cell lines (Ginting et al. (2017) *Oncolytic Virotherapy* 6:21-30).

Genetically engineered NDV strains also have been evaluated for oncolytic therapy. For example, the influenza NS1 gene, an IFN antagonist, was introduced into the genome of NDV strain Hitchner-B1, resulting in an enhanced oncolytic effect in a variety of human tumor cell lines and a mouse model of B16 melanoma (Tayeb et al. (2015)). The antitumor/immunostimulatory effects of NDV have been augmented by introduction of IL-2 or GM-CSF genes into the viral genome (Lam et al. (2011)). Combination therapy, utilizing intratumoral NDV injection with systemic CTLA-4 antibody administration resulted in the efficient rejection of pre-established distant tumors (Matveeva et al. (2015)).

h. Parvovirus

H-1 parvovirus (H-1PV) is a small, non-enveloped single-stranded DNA virus belonging to the family Parvoviridae, whose natural host is the rat (Angelova et al. (2017) *Front. Oncol.* 7:93; Angelova et al. (2015) *Frontiers in Bioengineering and Biotechnology* 3:55). H-1PV is nonpathogenic to humans, and is attractive as an oncolytic virus due to its favorable safety profile, the absence of preexisting H-1PV immunity in humans, and their lack of host cell genome integration (Angelova et al. (2015)). H-1PV has demonstrated broad oncosuppressive activity against solid tumors, including preclinical models of breast, gastric, cervical, brain, pancreatic and colorectal cancer, as well as hematological malignancies, including lymphoma and leukemia (Angelova et al. (2017)). H-1PV stimulates anti-tumor responses via the increased presentation of tumor-associated antigens, maturation of dendritic cells, and the release of pro-inflammatory cytokines (Moehler et al. (2014) *Frontiers in Oncology* 4:92). H-1PV also displays tumor selectivity, which is thought to be due to the availability of cellular replication and transcription factors, the overexpression of cellular proteins that interact with the NS1 parvoviral protein, and the activation of metabolic pathways involved in the functional regulation of NS1 in tumor cells, but not normal cells. Due to the innocuous nature of H-1PV, the wild type strain is often utilized, negating the need for attenuation by genetic engineering (Angelova et al. (2015)).

Studies have shown that oncolytic H-1PV infection of human glioma cells results in efficient cell killing, and high-grade glioma stem cell models were also permissive to lytic H-1PV infection. Enhanced killing of glioma cells has been observed when the virus was applied shortly after tumor cell irradiation, indicating that this protocol can be useful in non-resectable recurrent glioblastoma (Angelova et al. (2017)). Intracerebral or systemic H-1PV injection led to regression of gliomas without toxic side effects in immunocompetent rats with orthotopic RG-2 tumors, as well as in immunodeficient animals implanted with human U87 gliomas (Angelova et al. (2015)). Del H-1PV, a fitness variant with higher infectivity and spreading in human transformed cell lines, demonstrated oncolytic effects in vivo in pancreatic cancer and cervix carcinoma xenograft models (Geiss et al. (2017) *Viruses* 9, 301). H-1PV also demonstrated oncolytic activity against a panel of five human osteosarcoma cell lines (CAL 72, H-OS, MG-63, SaOS-2, U-2OS) (Geiss et al. (2017) *Viruses* 9, 301) and against human melanoma cells (SK29-Mel-1, SK29-Mel-1.22) (Moehler et al. (2014) *Frontiers in Oncology* 4:92). In another study, nude rats bearing cervical carcinoma xenografts demonstrated dose-dependent tumor growth arrest and regression following treatment with H-1PV (Angelova et al. (2015)). The intratumoral and intravenous administration of H-1PV also demonstrated significant growth suppression in human mammary carcinoma xenografts in immunocompromised mice (Angelova et al. (2015)). Intratumoral H-1PV injection in human gastric carcinoma or human Burkitt lymphoma-bearing mice resulted in tumor regression and growth suppression (Angelova et al. (2015)).

A phase Ulla clinical trial of an oncolytic H-1PV (ParvOryx01) in recurrent glioblastoma multiforme patients (clinical trial NCT01301430), demonstrated progression-free survival, clinical safety and patient tolerability with intratumoral or intravenous injection (Angelova et al. (2017); Geiss et al. (2017) *Viruses* 9, 301; Geletneky et al. (2017) *Mol. Ther.* 25(12):2620-2634). This trial demonstrated the ability of H-1PV to cross the blood-brain barrier in a dose-dependent manner and to establish an immunogenic anti-tumor response, characterized by leukocytic infiltration, predominantly by $CD8^+$ and $CD4^+$ T lymphocytes, and the detection in locally treated tumors of several markers of immune cell activation, including perforin, granzyme B, IFNγ, IL-2, CD25 and CD40L (Geletneky et al. (2017) *Mol. Ther.* 25(12):2620-2634).

H-1PV also has demonstrated efficient killing of highly aggressive pancreatic ductal adenocarcinoma (PDAC) cells in vitro, including those resistant to gemcitabine, and intratumoral injection of H-1PV resulted in tumor regression and prolonged animal survival in an orthotopic rat model of PDAC (Angelova et al. (2017); Angelova et al. (2015)). Similar results, including selective tumor targeting and absence of toxicity, were observed in an immunodeficient nude rat PDAC model (Angelova et al. (2015)). The combination of H-1PV and cytostatic (cisplatin, vincristine) or targeted (sunitinib) drugs results in the synergistic induction of apoptosis in human melanoma cells (Moehler et al. (2014)). The combination of H-1PV and valproic acid, an HDAC inhibitor, resulted in synergistic cytotoxicity towards cervical and pancreatic cancer cells (Angelova et al. (2017)), while the therapeutic efficiency of gemcitabine was improved when combined with H-1PV in a two-step protocol (Angelova et al. (2015)). As with other viruses, H-1PV can be engineered to express anti-cancer molecules. For example, studies have shown that a parvovirus-H1-derived vector expressing Apoptin had a greater capacity to induce apoptosis than wild-type H-1PV (Geiss et al. (2017)).

i. Coxsackie Virus

Coxsackie virus (CV) belongs to the genus Enterovirus and the family Picornaviridae and has a positive-sense single-stranded RNA genome that does not integrate into the host cell genome. CVs are classified into groups A and B, based on their effects in mice, and can cause mild upper respiratory tract infections in humans (Bradley et al. (2014) *Oncolytic Virotheraphy* 3:47-55). Commonly investigated coxsackie viruses for oncolytic virotherapy include attenuated coxsackie virus B3 (CV-B3), CV-B4, CV-A9 and CV-A21 (Yla-Pelto et al. (2016) *Viruses* 8, 57). CV-A21 infects cells via the ICAM-1 (or CD54) and DAF (or CD55) receptors, which are expressed at much higher levels in tumor cells, including melanoma, breast, colon, endometrial, head and neck, pancreatic and lung cancers, as well as in multiple myeloma and malignant glioma. CV-A21 has shown promising preclinical anticancer activity in vitro against malignant myeloma, melanoma, and prostate, lung, head and neck, and breast cancer cells lines, and in vivo in mice bearing human melanoma xenografts, and against primary breast cancer tumors as well as their metastases in mice (Yla-Pelto et al. (2016); Bradley et al. (2014)). A derivative of CV-A21, CV-A21-DAFv, also known as CAVATAK™, was generated from the wild-type Kuykendall strain by serial passage of CV-A21 on DAF-expressing, ICAM-1-negative rhabdomyosarcoma (RD) cells and was found to possess enhanced oncolytic properties in comparison to the parent strain. CAVATAK™ oncolytic virus binds only to the DAF receptor, which can contribute to its enhanced tropism towards cancer cells (Yla-Pelto et al. (2016)).

CV-A21 also has been studied in combination with doxorubicin hydrochloride, exhibiting enhanced oncolytic efficiency compared to either treatment alone against human breast, colorectal and pancreatic cancer cell lines, as well as in a xenograft mouse model of human breast cancer (Yla-Pelto et al. (2016)). Since a significant portion of the population has already developed neutralizing antibodies against CV, CV-A21 therapy has been combined with immunosuppressants such as cyclophosphamide (Bradley et al. (2014)) and is a good candidate for delivery via vehicle cells.

Clinical trials have investigated the use of CAVATAK™ oncolytic viral therapy in patients with stage IIIc or IV malignant melanoma (NCT01636882; NCT00438009; NCT01227551), and CAVATAK™ oncolytic viral therapy alone or in combination with low dose mitomycin C in patients with non-muscle invasive bladder cancer (NCT02316171). Clinical trials also have studied the effects of intravenous administration of CV-A21 in the treatment of solid tumors including melanoma, breast and prostate cancer (NCT00636558). Ongoing clinical trials include the investigation of CAVATAK™ oncolytic viral therapy alone or in combination with pembrolizumab for treatment of patients with non-small cell lung cancer (NCT02824965, NCT02043665) and bladder cancer (NCT02043665); CAVATAK™ coxsackievirus A21 in combination with ipilimumab in patients with uveal melanoma and liver metastases (NCT03408587) and in patients with advanced melanoma (NCT02307149); and CAVATAK™ coxsackievirus A21 in combination with pembrolizumab in patients with advanced melanoma (NCT02565992).

j. Seneca Valley Virus

Seneca Valley Virus (SVV) is a member of the Senecavirus genus within the family Picornaviridae, that has a positive-sense single-stranded RNA genome and is selective for neuroendocrine cancers, including neuroblastoma, rhabdomyosarcoma, medulloblastoma, Wilms tumor, glioblastoma and small-cell lung cancer (Miles et al. (2017) *J. Clin. Invest.* 127(8):2957-2967; Qian et al. (2017) *J. Virol.* 91(16): e00823-17; Burke, M. J. (2016) *Oncolytic Virotherapy* 5:81-89). Studies have identified the anthrax toxin receptor 1 (ANTXR1) as the receptor for SVV, which is frequently expressed on the surface of tumor cells in comparison to normal cells, but prior studies also have indicated that sialic acid can be a component of the SVV receptor in pediatric glioma models (Miles et al. (2017)). SVV isolate 001 (SVV-001) is a potent oncolytic virus that can target and penetrate solid tumors following intravenous administration, and is attractive due to its lack of insertional mutagenesis as well as its selective tropism for cancer cells and its non-pathogenicity in humans and animals. Additionally, previous exposure in humans is rare, resulting in low rates of preexisting immunity (Burke, M. J. (2016) *Oncolytic Virotherapy* 5:81-89).

SVV-001 has shown promising in vitro activity against small-cell lung cancer, adrenal gland cortical carcinoma, neuroblastoma, rhabdomyosarcoma, and Ewing sarcoma cell lines, and in vivo activity in orthotopic xenograft mouse models of pediatric GBM, medulloblastoma, retinoblastoma, rhabdomyosarcoma and neuroblastoma (Burke (2016)). NTX-010, an oncolytic SVV-001 developed by Neotropix®, is for the treatment of pediatric patients with relapsed/refractory solid tumors alone or in combination with cyclophosphamide, but was limited in its therapeutic efficacy due to the development of neutralizing antibodies (Burke et al. (2015) *Pediatr. Blood Cancer* 62(5):743-750). Clinical trials include studies using SV-001 in patients with solid tumors with neuroendocrine features (NCT00314925), NTX-010/SVV-001 in combination with cyclophosphamide in patients with relapsed or refractory neuroblastoma, rhabdomyosarcoma, Wilms tumor, retinoblastoma, adrenocortical carcinoma or carcinoid tumors (NCT01048892), and NTX-010/SVV-001 in patients with small cell lung cancer after chemotherapy (NCT01017601).

H. PHARMACEUTICAL PRODUCTION, COMPOSITIONS, AND FORMULATIONS

Provided herein are methods for manufacturing, pharmaceutical compositions and formulations containing any of the immunostimulatory bacteria provided herein and pharmaceutically acceptable excipients or additives. The pharmaceutical compositions can be used in treatment of diseases, such as hyperproliferative diseases or conditions, such as a tumor or cancer. The immunostimulatory bacteria can be administered in a single agent therapy, or can be administered in a combination therapy with a further agent or treatment. The compositions can be formulated for single dosage administration or for multiple dosage administration. The agents can be formulated for direct administration. The compositions can be provided as a liquid or dried formulation.

1. Manufacturing a. Cell Bank Manufacturing

As the active ingredient of the immunotherapeutic described herein is composed of engineered self-replicating bacteria, the selected composition will be expanded into a series of cell banks that will be maintained for long-term storage and as the starting material for manufacturing of drug substance. Cell banks are produced under current good manufacturing practices (cGMP) in an appropriate manufacturing facility per the Code of Federal Regulations (CFR) 21 part 211 or other relevant regulatory authority. As the active agent of the immunotherapeutic is a live bacterium, the products described herein are, by definition, non-sterile and cannot be terminally sterilized. Care must be taken to ensure that aseptic procedures are used throughout the manufacturing process to prevent contamination. As such, all raw materials and solutions must be sterilized prior to use in the manufacturing process.

A master cell bank (MCB) is produced by sequential serial single colony isolation of the selected bacterial strain to ensure no contaminants are present in the starting material. A sterile culture vessel containing sterile media (can be complex media e.g., LB or MSBB or defined media e.g., M9 supplemented with appropriate nutrients) is inoculated with a single well-isolated bacterial colony and the bacteria are allowed to replicate e.g., by incubation at 37° C. with shaking. The bacteria are then prepared for cryopreservation by suspension in a solution containing a cryoprotective agent or agents.

Examples of cryoprotective agents include: proteins such as human or bovine serum albumin, gelatin, and immunoglobulins; carbohydrates including monosaccharides (galactose, D-mannose, sorbose, etc.) and their non-reducing derivatives (e.g., methylglucoside), disaccharides (trehalose, sucrose, etc.), cyclodextrins, and polysaccharides (raffinose, maltodextrins, dextrans, etc.); amino-acids (glutamate, glycine, alanine, arginine or histidine, tryptophan, tyrosine, leucine, phenylalanine, etc.); methylamines such as betaine; polyols such as trihydric or higher sugar alcohols, e.g., glycerin, erythritol, glycerol, arabitol, xylitol, sorbitol, and mannitol; propylene glycol; polyethylene glycol; surfactants e.g., pluronic; or organo-sulfur compounds such as dimethyl sulfoxide (DMSO), and combinations thereof. Cryopreservation solutions can include one or more cryoprotective agents in a solution that can also contain salts (e.g., sodium chloride, potassium chloride, magnesium sulfate), and/or buffering agents such as sodium phosphate, tris(hydroxymethyl)aminomethane (TRIS), 4-(2-hydroxyethyl)-1-piperazineethanesulfonic acid (HEPES), and other such buffering agents known to those of skill.

Suspension of the bacteria in cryopropreservation solution can be achieved either by addition of a concentrated cryoprotective agent or agents to the culture material to achieve a final concentration that preserves viability of the bacteria during the freezing and thawing process (e.g., 0.5% to 20% final concentration of glycerol), or by harvesting the bacteria (e.g., by centrifugation) and suspending in a cryopreservative solution containing the appropriate final concentration of cryoprotective agent(s). The suspension of bacteria in cryopreservation solution is then filled into appropriate sterile vials (plastic or glass) with a container closure system that is capable of maintaining closure integrity under frozen conditions (e.g., butyl stoppers and crimp seals). The vials of master cell bank are then frozen (either slowly by means of a controlled rate freezer, or quickly by means of placing directly into a freezer). The MCB is then stored frozen at a temperature that preserves long-term viability (e.g., at or below −60° C.). Thawed master cell bank material is thoroughly characterized to ensure identity, purity, and activity per regulation by the appropriate authorities.

Working cell banks (WCBs) are produced much the same way as the master cell bank, but the starting material is derived from the MCB. MCB material can be directly transferred into a fermentation vessel containing sterile media and expanded as above. The bacteria are then suspended in a cryopreservation solution, filled into containers, sealed, and frozen at or below −20° C. Multiple WCBs can be produced from MCB material, and WCB material can be used to make additional cell banks (e.g., a manufacturer's working cell bank MWCB). WCBs are stored frozen and characterized to ensure identity, purity, and activity. WCB material is typically the starting material used in production of the drug substance of biologics such as engineered bacteria.

b. Drug Substance Manufacturing

Drug substance is manufactured using aseptic processes under cGMP as described above. Working cell bank material is typically used as starting material for manufacturing of drug substance under cGMP, however other cell banks can be used (e.g., MCB or MWCB). Aseptic processing is used for production of all cell therapies including bacterial cell-based therapies. The bacteria from the cell bank are expanded by fermentation; this can be achieved by production of a pre-culture (e.g., in a shake flask) or by direct inoculation of a fermenter. Fermentation is accomplished in a sterile bioreactor or flask that can be single-use disposable or re-usable. Bacteria are harvested by concentration (e.g., by centrifugation, continuous centrifugation, or tangential flow filtration). Concentrated bacteria are purified from media components and bacterial metabolites by exchange of the media with buffer (e.g., by diafiltration). The bulk drug product is formulated and preserved as an intermediate (e.g., by freezing or drying) or is processed directly into a drug product. Drug substance is tested for identity, strength, purity, potency, and quality.

c. Drug Product Manufacturing

Drug product is defined as the final formulation of the active substance contained in its final container. Drug product is manufactured using aseptic processes under cGMP. Drug product is produced from drug substance. Drug substance is thawed or reconstituted if necessary, then formulated at the appropriate target strength. Because the active component of the drug product is live, engineered bacteria, the strength is determined by the number of CFU contained within the suspension. The bulk product is diluted in a final formulation appropriate for storage and use as described below. Containers are filled, and sealed with a container closure system and the drug product is labeled. The drug product is stored at an appropriate temperature to preserve stability and is tested for identity, strength, purity, potency, and quality and released for human use if it meets specified acceptance criteria.

2. Compositions

Pharmaceutically acceptable compositions are prepared in view of approvals for a regulatory agency or other agency prepared in accordance with generally recognized pharmacopeia for use in animals and in humans. The compositions can be prepared as solutions, suspensions, powders, or sustained release formulations. Typically, the compounds are formulated into pharmaceutical compositions using techniques and procedures well known in the art (see e.g., Ansel *Introduction to Pharmaceutical Dosage Forms*, Fourth Edition, 1985, 126). The formulation should suit the mode of administration.

Compositions can be formulated for administration by any route known to those of skill in the art including intramuscular, intravenous, intradermal, intralesional, intraperitoneal injection, subcutaneous, intratumoral, epidural, nasal, oral, vaginal, rectal, topical, local, otic, inhalational, buccal (e.g., sublingual), and transdermal administration or any route of administration. Other modes of administration also are contemplated. Administration can be local, topical or systemic depending upon the locus of treatment. Local administration to an area in need of treatment can be achieved by, for example, but not limited to, local infusion during surgery, topical application, e.g., in conjunction with a wound dressing after surgery, by injection, by means of a catheter, by means of a suppository, or by means of an implant. Compositions also can be administered with other biologically active agents, either sequentially, intermittently or in the same composition. Administration also can include controlled release systems including controlled release formulations and device controlled release, such as by means of a pump.

The most suitable route in any given case depends on a variety of factors, such as the nature of the disease, the progress of the disease, the severity of the disease and the particular composition which is used. Pharmaceutical compositions can be formulated in dosage forms appropriate for each route of administration. In particular, the compositions can be formulated into any suitable pharmaceutical preparations for systemic, local intraperitoneal, oral or direct administration. For example, the compositions can be formulated for administration subcutaneously, intramuscularly, intratumorally, intravenously or intradermally. Administration methods can be employed to decrease the exposure of the active agent to degradative processes, such as immunological intervention via antigenic and immunogenic responses. Examples of such methods include local administration at the site of treatment or continuous infusion.

The immunostimulatory bacteria can be formulated into suitable pharmaceutical preparations such as solutions, suspensions, tablets, dispersible tablets, pills, capsules, powders, sustained release formulations or elixirs, for oral administrations, as well as transdermal patch preparations and dry powder inhalers. Typically, the compounds are formulated into pharmaceutical compositions using techniques and procedures well known in the art (see e.g., Ansel *Introduction to Pharmaceutical Dosage Forms*, Fourth Edition, 1985, 126). Generally, the mode of formulation is a function of the route of administration. The compositions can be formulated in dried (lyophilized or other forms of vitrification) or liquid form. Where the compositions are provided in dried form they can be reconstituted just prior to use by addition of an appropriate buffer, for example, a sterile saline solution.

3. Formulations a. Liquids, Injectables, Emulsions

The formulation generally is made to suit the route of administration. Parenteral administration, generally characterized by injection or infusion, either subcutaneously, intramuscularly, intratumorally, intravenously or intradermally is contemplated herein. Preparations of bacteria for parenteral administration include suspensions ready for injection (direct administration) or frozen suspensions that are thawed prior to use, dry soluble products, such as lyophilized powders, ready to be combined with a resuspension solution just prior to use, and emulsions. Dried thermostable formulations such as lyophilized formulations can be used for storage of unit doses for later use.

The pharmaceutical preparation can be in a frozen liquid form, for example a suspension. If provided in frozen liquid form, the drug product can be provided as a concentrated preparation to be thawed and diluted to a therapeutically effective concentration before use.

The pharmaceutical preparations also can be provided in a dosage form that does not require thawing or dilution for use. Such liquid preparations can be prepared by conventional means with pharmaceutically acceptable additives, as appropriate, such as suspending agents (e.g., sorbitol, cellulose derivatives or hydrogenated edible fats); emulsifying agents (e.g., lecithin or acacia); non-aqueous vehicles (e.g., almond oil, oily esters, or fractionated vegetable oils); and preservatives suitable for use with microbial therapeutics. The pharmaceutical preparations can be presented in dried form, such as lyophilized or spray-dried, for reconstitution with water or other sterile suitable vehicle before use.

Suitable excipients are, for example, water, saline, dextrose, or glycerol. The solutions can be either aqueous or nonaqueous. If administered intravenously, suitable carriers include physiological saline or phosphate buffered saline (PBS), and other buffered solutions used for intravenous hydration. For intratumoral administration solutions containing thickening agents such as glucose, polyethylene glycol, and polypropylene glycol, oil emulsions and mixtures thereof can be appropriate to maintain localization of the injectant.

Pharmaceutical compositions can include carriers or other excipients. For example, pharmaceutical compositions provided herein can contain any one or more of a diluents(s), adjuvant(s), antiadherent(s), binder(s), coating(s), filler(s), flavor(s), color(s), lubricant(s), glidant(s), preservative(s), detergent(s), or sorbent(s) and a combination thereof or vehicle with which a modified therapeutic bacteria is administered. For example, pharmaceutically acceptable carriers or excipients used in parenteral preparations include aqueous vehicles, nonaqueous vehicles, isotonic agents, buffers, antioxidants, local anesthetics, suspending and dispersing agents, emulsifying agents, sequestering or chelating agents and other pharmaceutically acceptable substances. Formulations, including liquid preparations, can be prepared by conventional means with pharmaceutically acceptable additives or excipients.

Pharmaceutical compositions can include carriers such as a diluent, adjuvant, excipient, or vehicle with which the compositions are administered. Examples of suitable pharmaceutical carriers are described in "Remington's Pharmaceutical Sciences" by E. W. Martin. Such compositions will contain a therapeutically effective amount of the compound or agent, generally in purified form or partially purified form, together with a suitable amount of carrier so as to provide the form for proper administration to the patient. Such pharmaceutical carriers can be sterile liquids, such as water and oils, including those of petroleum, animal, vegetable or synthetic origin, such as peanut oil, soybean oil, mineral oil, and sesame oil. Water is a typical carrier. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyvinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. For example, suitable excipients are, for example, water, saline, dextrose, glycerol or ethanol. A composition, if desired, also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins.

Pharmaceutically acceptable carriers used in parenteral preparations include aqueous vehicles, nonaqueous vehicles, antimicrobial agents, isotonic agents, buffers, antioxidants, local anesthetics, suspending and dispersing agents, emulsifying agents, sequestering or chelating agents and other pharmaceutically acceptable substances. Examples of aqueous vehicles include Sodium Chloride Injection, Ringers Injection, Isotonic Dextrose Injection, Sterile Water Injection, Dextrose and Lactated Ringers Injection. Nonaqueous parenteral vehicles include fixed oils of vegetable origin, cottonseed oil, corn oil, sesame oil and peanut oil. Isotonic agents include sodium chloride and dextrose. Buffers include phosphate and citrate. Antioxidants include sodium bisulfate. Local anesthetics include procaine hydrochloride. Suspending and dispersing agents include sodium carboxymethylcellulose, hydroxypropyl methylcellulose and polyvinylpyrrolidone. Emulsifying agents include, for example, polysorbates, such Polysorbate 80 (TWEEN 80). Sequestering or chelating agents of metal ions, such as EDTA, can be included. Pharmaceutical carriers also include polyethylene glycol and propylene glycol for water miscible vehicles and sodium hydroxide, hydrochloric acid, citric acid or lactic acid for pH adjustment. Non-antimicrobial preservatives can be included.

The pharmaceutical compositions also can contain other minor amounts of non-toxic auxiliary substances such as wetting or emulsifying agents, pH buffering agents, stabilizers, solubility enhancers, and other such agents, such as for example, sodium acetate, sorbitan monolaurate, triethanolamine oleate and cyclodextrins. Implantation of a slow-release or sustained-release system, such that a constant level of dosage is maintained (see, e.g., U.S. Pat. No. 3,710,795) also is contemplated herein. The percentage of active compound contained in such parenteral compositions is highly dependent on the specific nature thereof, as well as the activity of the compound and the needs of the subject.

b. Dried Thermostable Formulations

The bacteria can be dried. Dried thermostable formulations, such as lyophilized or spray dried powders and vitrified glass can be reconstituted for administration as solutions, emulsions and other mixtures. The dried thermostable formulation can be prepared from any of the liquid formulations, such as the suspensions, described above. The pharmaceutical preparations can be presented in lyophilized or vitrified form for reconstitution with water or other suitable vehicle before use.

The thermostable formulation is prepared for administration by reconstituting the dried compound with a sterile solution. The solution can contain an excipient which improves the stability or other pharmacological attribute of the active substance or reconstituted solution, prepared from the powder. The thermostable formulation is prepared by dissolving an excipient, such as dextrose, sorbitol, fructose, corn syrup, xylitol, glycerin, glucose, sucrose or other suitable agent, in a suitable buffer, such as citrate, sodium or potassium phosphate or other such buffer known to those of skill in the art. Then, the drug substance is added to the resulting mixture, and stirred until it is mixed. The resulting mixture is apportioned into vials for drying. Each vial will contain a single dosage containing $1\times10^5$-$1\times10^{11}$ CFU per vial. After drying, the product vial is sealed with a container closure system that prevents moisture or contaminants from entering the sealed vial. The dried product can be stored under appropriate conditions, such as at −20° C., 4° C., or room temperature. Reconstitution of this dried formulation with water or a buffer solution provides a formulation for use in parenteral administration. The precise amount depends upon the indication treated and selected compound. Such amount can be empirically determined.

4. Compositions for Other Routes of Administration

Depending upon the condition treated, other routes of administration in addition to parenteral, such as topical application, transdermal patches, oral and rectal administration are also contemplated herein. The suspensions and powders described above can be administered orally or can be reconstituted for oral administration. Pharmaceutical dosage forms for rectal administration are rectal suppositories, capsules and tablets and gel capsules for systemic effect. Rectal suppositories include solid bodies for insertion into the rectum which melt or soften at body temperature releasing one or more pharmacologically or therapeutically active ingredients. Pharmaceutically acceptable substances in rectal suppositories are bases or vehicles and agents to raise the melting point. Examples of bases include cocoa butter (theobroma oil), glycerin-gelatin, carbowax (polyoxyethylene glycol) and appropriate mixtures of mono-, di- and triglycerides of fatty acids. Combinations of the various bases can be used. Agents to raise the melting point of suppositories include spermaceti and wax. Rectal suppositories can be prepared either by the compressed method or by molding. The typical weight of a rectal suppository is about 2 to 3 gm. Tablets and capsules for rectal administration are manufactured using the same pharmaceutically acceptable substance and by the same methods as for formulations for oral administration. Formulations suitable for rectal administration can be provided as unit dose suppositories. These can be prepared by admixing the drug substance with one or more conventional solid carriers, for example, cocoa butter, and then shaping the resulting mixture.

For oral administration, pharmaceutical compositions can take the form of, for example, tablets or capsules prepared by conventional means with pharmaceutically acceptable excipients such as binding agents (e.g., pregelatinized maize starch, polyvinyl pyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulfate). The tablets can be coated by methods well-known in the art.

Formulations suitable for buccal (sublingual) administration include, for example, lozenges containing the active compound in a flavored base, usually sucrose and acacia or tragacanth; and pastilles containing the compound in an inert base such as gelatin and glycerin or sucrose and acacia.

Topical mixtures are prepared as described for the local and systemic administration. The resulting mixtures can be solutions, suspensions, emulsions or the like and are formulated as creams, gels, ointments, emulsions, solutions, elixirs, lotions, suspensions, tinctures, pastes, foams, aerosols, irrigations, sprays, suppositories, bandages, dermal patches or any other formulations suitable for topical administration.

The compositions can be formulated as aerosols for topical application, such as by inhalation (see, e.g., U.S. Pat. Nos. 4,044,126; 4,414,209 and 4,364,923, which describe aerosols for delivery of a steroid useful for treatment of lung diseases). These formulations, for administration to the respiratory tract, can be in the form of an aerosol or solution for a nebulizer, or as a microfine powder for insufflation, alone or in combination with an inert carrier such as lactose. In such a case, the particles of the formulation will typically have diameters of less than 50 microns, or less than 10 microns.

The compounds can be formulated for local or topical application, such as for topical application to the skin and mucous membranes, such as in the eye, in the form of gels, creams, and lotions and for application to the eye or for intracisternal or intraspinal application. Topical administration is contemplated for transdermal delivery and also for administration to the eyes or mucosa, or for inhalation therapies. Nasal solutions of the active compound alone or in combination with other pharmaceutically acceptable excipients also can be administered.

Formulations suitable for transdermal administration are provided. They can be provided in any suitable format, such as discrete patches adapted to remain in intimate contact with the epidermis of the recipient for a prolonged period of time. Such patches contain the active compound in an optionally buffered aqueous solution of, for example, 0.1 to 0.2 M concentration with respect to the active compound. Formulations suitable for transdermal administration also can be delivered by iontophoresis (see, e.g., Tyle, P, (1986) *Pharmaceutical Research* 3(0:318-326) and typically take the form of an optionally buffered aqueous solution of the active compound.

Pharmaceutical compositions also can be administered by controlled release formulations and/or delivery devices (see e.g., U.S. Pat. Nos. 3,536,809; 3,598,123; 3,630,200; 3,845,770; 3,916,899; 4,008,719; 4,769,027; 5,059,595; 5,073,543; 5,120,548; 5,591,767; 5,639,476; 5,674,533 and 5,733,566).

5. Dosages and Administration

The compositions can be formulated as pharmaceutical compositions for single dosage or multiple dosage administration. The immunostimulatory bacteria can be included in an amount sufficient to exert a therapeutically useful effect in the absence of undesirable side effects on the patient treated. For example, the concentration of the pharmaceutically active compound is adjusted so that an injection provides an effective amount to produce the desired pharmacological effect. The therapeutically effective concentration can be determined empirically by testing the immunostimulatory bacteria in known in vitro and in vivo systems such as by using the assays described herein or known in the art. For example, standard clinical techniques can be employed. In vitro assays and animal models can be employed to help identify optimal dosage ranges. The precise dose, which can be determined empirically, can depend on the age, weight, body surface area, and condition of the patient or animal, the particular immunostimulatory bacteria administered, the route of administration, the type of disease to be treated and the seriousness of the disease.

Hence, it is understood that the precise dosage and duration of treatment is a function of the disease being treated and can be determined empirically using known testing protocols or by extrapolation from in vivo or in vitro test data. Concentrations and dosage values also can vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or use of compositions and combinations containing them. The compositions can be administered hourly, daily, weekly, monthly, yearly or once. Generally, dosage regimens are chosen to limit toxicity. It should be noted that the attending physician would know how to and when to terminate, interrupt or adjust therapy to lower dosage due to toxicity, or bone marrow, liver or kidney or other tissue dysfunctions. Conversely, the attending physician would also know how to and when to adjust treatment to higher levels if the clinical response is not adequate (precluding toxic side effects).

The immunostimulatory bacteria are included in the composition in an amount sufficient to exert a therapeutically useful effect. For example, the amount is one that achieves a therapeutic effect in the treatment of a hyperproliferative disease or condition, such as cancer.

Pharmaceutically and therapeutically active compounds and derivatives thereof are typically formulated and administered in unit dosage forms or multiple dosage forms. Each unit dose contains a predetermined quantity of therapeutically active compound sufficient to produce the desired therapeutic effect, in association with the required pharmaceutical carrier, vehicle or diluent. Unit dosage forms, include, but are not limited to, tablets, capsules, pills, powders, granules, parenteral suspensions, and oral solutions or suspensions, and oil-in-water emulsions containing suitable quantities of the compounds or pharmaceutically acceptable derivatives thereof. Unit dose forms can be contained in vials, ampoules and syringes or individually packaged tablets or capsules. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging. Generally, dosage forms or compositions containing active ingredient in the range of 0.005% to 100% with the balance made up from non-toxic carrier can be prepared. Pharmaceutical compositions can be formulated in dosage forms appropriate for each route of administration.

The unit-dose parenteral preparations are packaged in an ampoule, a vial or a syringe with a needle. The volume of liquid solution or reconstituted powder preparation, containing the pharmaceutically active compound, is a function of the disease to be treated and the particular article of manufacture chosen for package. All preparations for parenteral administration must be sterile, as is known and practiced in the art.

As indicated, compositions provided herein can be formulated for any route known to those of skill in the art including, but not limited to, subcutaneous, intramuscular, intravenous, intradermal, intralesional, intraperitoneal injection, epidural, vaginal, rectal, local, otic, transdermal administration or any route of administration. Formulations suited for such routes are known to one of skill in the art. Compositions also can be administered with other biologically active agents, either sequentially, intermittently or in the same composition.

Pharmaceutical compositions can be administered by controlled release formulations and/or delivery devices (see, e.g., U.S. Pat. Nos. 3,536,809; 3,598,123; 3,630,200; 3,845,770; 3,847,770; 3,916,899; 4,008,719; 4,687,660; 4,769,027; 5,059,595; 5,073,543; 5,120,548; 5,354,556; 5,591,767; 5,639,476; 5,674,533 and 5,733,566). Various delivery systems are known and can be used to administer selected compositions, are contemplated for use herein, and such particles can be easily made.

6. Packaging and Articles of Manufacture

Also provided are articles of manufacture containing packaging materials, any pharmaceutical composition provided herein, and a label that indicates that the compositions are to be used for treatment of diseases or conditions as described herein. For example, the label can indicate that the treatment is for a tumor or cancer.

Combinations of immunostimulatory bacteria described herein and another therapeutic agent also can be packaged in an article of manufacture. In one example, the article of manufacture contains a pharmaceutical composition containing the immunostimulatory bacteria composition and no further agent or treatment. In other examples, the article of manufacture contains another further therapeutic agent, such as a different anti-cancer agent. In this example, the agents can be provided together or separately, for packaging as articles of manufacture.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. Exemplary of articles of manufacture are containers including single chamber and dual chamber containers. The containers include, but are not limited to, tubes, bottles and syringes. The containers can further include a needle for intravenous administration.

The choice of package depends on the agents, and whether such compositions will be packaged together or separately. In general, the packaging is non-reactive with the compositions contained therein. In other examples, some of the components can be packaged as a mixture. In other examples, all components are packaged separately. Thus, for example, the components can be packaged as separate compositions that, upon mixing just prior to administration, can be directly administered together. Alternatively, the components can be packaged as separate compositions for administration separately.

Selected compositions including articles of manufacture thereof also can be provided as kits. Kits can include a pharmaceutical composition described herein and an item for administration provided as an article of manufacture. The compositions can be contained in the item for administration or can be provided separately to be added later. The kit can, optionally, include instructions for application including dosages, dosing regimens and instructions for modes of administration. Kits also can include a pharmaceutical composition described herein and an item for diagnosis.

I. METHODS OF TREATMENT AND USES

The methods provided herein include methods of administering or using the immunostimulatory bacteria, for treating subjects having a disease or condition whose symptoms can be ameliorated or lessened by administration of such bacteria, such as cancer. In particular examples, the disease or condition is a tumor or a cancer. Additionally, methods of combination therapies with one or more additional agents for treatment, such as an anticancer agent or an anti-hyaluronan agent, also are provided. The bacteria can be administered by any suitable route, including, but not limited to, parenteral, systemic, topical and local, such as intra-tumoral, intravenous, rectal, oral, intramuscular, mucosal and other routes. Formulations suitable for each are provided. The skilled person can establish suitable regimens and doses and select routes.

1. Tumors

The immunostimulatory bacteria, combinations, uses and methods provided herein are applicable to treating all types of tumors, including cancers, particularly solid tumors including lung cancer, bladder cancer, non-small cell lung cancer, gastric cancers, head and neck cancers, ovarian cancer, liver cancer, pancreatic cancer, kidney cancer, breast cancer, colorectal cancer, and prostate cancer. The methods also can be used for hematological cancers.

Tumors and cancers subject to treatment by the uses and methods provided herein include, but are not limited to, those that originate in the immune system, skeletal system, muscles and heart, breast, pancreas, gastrointestinal tract, central and peripheral nervous system, renal system, reproductive system, respiratory system, skin, connective tissue systems, including joints, fatty tissues, and circulatory system, including blood vessel walls. Examples of tumors that can be treated with the immunostimulatory bacteria provided herein include carcinomas, gliomas, sarcomas (including liposarcoma), adenocarcinomas, adenosarcomas, and adenomas. Such tumors can occur in virtually all parts of the body, including, for example, breast, heart, lung, small intestine, colon, spleen, kidney, bladder, head and neck, ovary, prostate, brain, pancreas, skin, bone, bone marrow, blood, thymus, uterus, testicles, cervix or liver.

Tumors of the skeletal system include, for example, sarcomas and blastomas such as osteosarcoma, chondrosarcoma, and chondroblastoma. Muscle and heart tumors include tumors of both skeletal and smooth muscles, e.g., leiomyomas (benign tumors of smooth muscle), leiomyosarcomas, rhabdomyomas (benign tumors of skeletal muscle), rhabdomyosarcomas, and cardiac sarcomas. Tumors of the gastrointestinal tract include e.g., tumors of the mouth, esophagus, stomach, small intestine, colon and colorectal tumors, as well as tumors of gastrointestinal secretory organs such as salivary glands, liver, pancreas, and the biliary tract. Tumors of the central nervous system include tumors of the brain, retina, and spinal cord, and can also originate in associated connective tissue, bone, blood vessels or nervous tissue. Treatment of tumors of the peripheral nervous system are also contemplated. Tumors of the peripheral nervous system include malignant peripheral nerve sheath tumors. Tumors of the renal system include those of the kidneys, e.g., renal cell carcinoma, as well as tumors of the ureters and bladder. Tumors of the reproductive system include tumors of the cervix, uterus, ovary, prostate, testes and related secretory glands. Tumors of the immune system include both blood based and solid tumors, including lymphomas, e.g., both Hodgkin's and non-Hodgkin's. Tumors of the respiratory system include tumors of the nasal passages, bronchi and lungs. Tumors of the breast include, e.g., both lobular and ductal carcinoma.

Other examples of tumors that can be treated by the immunostimulatory bacteria and methods provided herein include Kaposi's sarcoma, CNS neoplasms, neuroblastomas, capillary hemangioblastomas, meningiomas and cerebral metastases, melanoma, gastrointestinal and renal carcinomas and sarcomas, rhabdomyosarcoma, glioblastoma (such as glioblastoma multiforme) and leiomyosarcoma. Examples of other cancers that can be treated as provided herein include but are not limited to lymphoma, blastoma, neuroendocrine tumors, mesothelioma, schwannoma, meningioma, melanoma, and leukemia or lymphoid malignancies. Examples of such cancers include hematologic malignancies, such as Hodgkin's lymphoma; non-Hodgkin's lymphomas (Burkitt's lymphoma, small lymphocytic lymphoma/chronic lymphocytic leukemia, mycosis fungoides, mantle cell lymphoma, follicular lymphoma, diffuse large B-cell lymphoma, marginal zone lymphoma, hairy cell leukemia and lymphoplasmacytic leukemia), tumors of lymphocyte precursor cells, including B-cell acute lymphoblastic leukemia/lymphoma, and T-cell acute lymphoblastic leukemia/lymphoma, thymoma, tumors of the mature T and NK cells, including peripheral T-cell leukemias, adult T-cell leukemia/T-cell lymphomas and large granular lymphocytic leukemia, Langerhans cell histiocytosis, myeloid neoplasias such as acute myelogenous leukemias, including AML with maturation, AML without differentiation, acute promyelocytic leukemia, acute myelomonocytic leukemia, and acute monocytic leukemias, myelodysplastic syndromes, and chronic myeloproliferative disorders, including chronic myelogenous leukemia; tumors of the central nervous system such as glioma, glioblastoma, neuroblastoma, astrocytoma, medulloblastoma, ependymoma, and retinoblastoma; solid tumors of the head and neck (e.g., nasopharyngeal cancer, salivary gland carcinoma, and esophageal cancer), lung (e.g., small-cell lung cancer, non-small cell lung cancer, adenocarcinoma of the lung and squamous carcinoma of the lung), digestive system (e.g., gastric or stomach cancer including gastrointestinal cancer, cancer of the bile duct or biliary tract, colon cancer, rectal cancer, colorectal cancer, and anal carcinoma), reproductive system (e.g., testicular, penile, or prostate cancer, uterine, vaginal, vulval, cervical, ovarian, and endometrial cancer), skin (e.g., melanoma, basal cell carcinoma, squamous cell cancer, actinic keratosis, cutaneous melanoma), liver (e.g., liver cancer, hepatic carcinoma, hepatocellular cancer, and hepatoma), bone (e.g., osteoclastoma, and osteolytic bone cancers) additional tissues and organs (e.g., pancreatic cancer, bladder cancer, kidney or renal cancer, thyroid cancer, breast cancer, cancer of the peritoneum, and Kaposi's sarcoma), tumors of the vascular system (e.g., angiosarcoma and hemangiopericytoma), Wilms' tumor, retinoblastoma, osteosarcoma and Ewing's sarcoma.

2. Administration

In practicing the uses and methods herein, immunostimulatory bacteria provided herein can be administered to a subject, including a subject having a tumor or having neoplastic cells, or a subject to be immunized. One or more steps can be performed prior to, simultaneously with, or after administration of the immunostimulatory bacteria to the subject including, but not limited to, diagnosing the subject with a condition appropriate for administering immunostimulatory bacteria, determining the immunocompetence of the subject, immunizing the subject, treating the subject with a chemotherapeutic agent, treating the subject with radiation, or surgically treating the subject.

For embodiments that include administering immunostimulatory bacteria to a tumor-bearing subject for therapeutic purposes, the subject typically has previously been diagnosed with a neoplastic condition. Diagnostic methods also can include determining the type of neoplastic condition, determining the stage of the neoplastic conditions, determining the size of one or more tumors in the subject, determining the presence or absence of metastatic or neoplastic cells in the lymph nodes of the subject, or determining the presence of metastases of the subject.

Some embodiments of therapeutic methods for administering immunostimulatory bacteria to a subject can include a step of determination of the size of the primary tumor or the stage of the neoplastic disease, and if the size of the primary tumor is equal to or above a threshold volume, or if the stage of the neoplastic disease is at or above a threshold stage, an immunostimulatory bacterium is administered to the subject. In a similar embodiment, if the size of the primary tumor is below a threshold volume, or if the stage of the neoplastic disease is at or below a threshold stage, the immunostimulatory bacterium is not yet administered to the subject; such methods can include monitoring the subject until the tumor size or neoplastic disease stage reaches a threshold amount, and then administering the immunostimulatory bacterium to the subject. Threshold sizes can vary according to several factors, including rate of growth of the tumor, ability of the immunostimulatory bacterium to infect a tumor, and immunocompetence of the subject. Generally the threshold size will be a size sufficient for an immunostimulatory bacterium to accumulate and replicate in or near the tumor without being completely removed by the host's immune system, and will typically also be a size sufficient to sustain a bacterial infection for a time long enough for the host to mount an immune response against the tumor cells, typically about one week or more, about ten days or more, or about two weeks or more. Exemplary threshold stages are any stage beyond the lowest stage (e.g., Stage I or equivalent), or any stage where the primary tumor is larger than a threshold size, or any stage where metastatic cells are detected.

Any mode of administration of a microorganism to a subject can be used, provided the mode of administration permits the immunostimulatory bacteria to enter a tumor or metastasis. Modes of administration can include, but are not limited to, intravenous, intraperitoneal, subcutaneous, intramuscular, topical, intratumoral, multipuncture, inhalation, intranasal, oral, intracavity (e.g., administering to the bladder via a catheter, administering to the gut by suppository or enema), aural, rectal, and ocular administration.

One skilled in the art can select any mode of administration compatible with the subject and the bacteria, and that also is likely to result in the bacteria reaching tumors and/or metastases. The route of administration can be selected by one skilled in the art according to any of a variety of factors, including the nature of the disease, the kind of tumor, and the particular bacteria contained in the pharmaceutical composition. Administration to the target site can be performed, for example, by ballistic delivery, as a colloidal dispersion system, or systemic administration can be performed by injection into an artery.

The dosage regimen can be any of a variety of methods and amounts, and can be determined by one skilled in the art according to known clinical factors. A single dose can be therapeutically effective for treating a disease or disorder in which immune stimulation effects treatment. Exemplary of such stimulation is an immune response, that includes, but is not limited to, one or both of a specific immune response and non-specific immune response, both specific and non-specific responses, innate response, primary immune response, adaptive immunity, secondary immune response, memory immune response, immune cell activation, immune cell proliferation, immune cell differentiation, and cytokine expression.

As is known in the medical arts, dosages for a subject can depend on many factors, including the subject's species, size, body surface area, age, sex, immunocompetence, and general health, the particular bacteria to be administered, duration and route of administration, the kind and stage of the disease, for example, tumor size, and other compounds such as drugs being administered concurrently. In addition to the above factors, such levels can be affected by the infectivity of the bacteria and the nature of the bacteria, as can be determined by one skilled in the art. In the present methods, appropriate minimum dosage levels of bacteria can be levels sufficient for the bacteria to survive, grow and replicate in a tumor or metastasis. Exemplary minimum levels for administering a bacterium to a 65 kg human can include at least about $5\times10^6$ colony forming units (CFU), at least about $1\times10^7$ CFU, at least about $5\times10^7$ CFU, at least about $1\times10^8$ CFU, or at least about $1\times10^9$ CFU. In the present methods, appropriate maximum dosage levels of bacteria can be levels that are not toxic to the host, levels that do not cause splenomegaly of 3× or more, and/or levels that do not result in colonies or plaques in normal tissues or organs after about 1 day or after about 3 days or after about 7 days. Exemplary maximum levels for administering a bacterium to a 65 kg human can include no more than about $5\times10^{11}$ CFU, no more than about $1\times10^{11}$ CFU, no more than about $5\times10^{10}$ CFU, no more than about $1\times10^{10}$ CFU, or no more than about $1\times10^{9}$ CFU.

The methods and uses provided herein can include a single administration of immunostimulatory bacteria to a subject or multiple administrations of immunostimulatory bacteria to a subject or others of a variety of regimens, including combination therapies with other anti-tumor therapeutics and/or treatments. These include, cellular therapies, such as administration of modified immune cells, CAR-T therapy, CRISPR therapy, immune checkpoint inhibitors, such as antibodies (e.g., anti-PD-1, anti-PD-L1 or anti-CTLA-4 antibodies), chemotherapy/chemotherapeutic compounds, such as nucleoside analogs, surgery and radiotherapy.

In some embodiments, a single administration is sufficient to establish immunostimulatory bacteria in a tumor, where the bacteria can colonize and can cause or enhance an anti-tumor response in the subject. In other embodiments, the immunostimulatory bacteria provided for use in the methods herein can be administered on different occasions, separated in time typically by at least one day. Separate administrations can increase the likelihood of delivering a bacterium to a tumor or metastasis, where a previous administration may have been ineffective in delivering the bacterium to a tumor or metastasis. In embodiments, separate administrations can increase the locations on a tumor or metastasis where bacterial colonization/proliferation can occur or can otherwise increase the titer of bacteria accumulated in the tumor, which can increase eliciting or enhancing a host's anti-tumor immune response.

When separate administrations are performed, each administration can be a dosage amount that is the same or different relative to other administration dosage amounts. In one embodiment, all administration dosage amounts are the same. In other embodiments, a first dosage amount can be a larger dosage amount than one or more subsequent dosage amounts, for example, at least 10× larger, at least 100× larger, or at least 1000× larger than subsequent dosage amounts. In one example of a method of separate administrations in which the first dosage amount is greater than one or more subsequent dosage amounts, all subsequent dosage amounts can be the same, smaller amount relative to the first administration.

Separate administrations can include any number of two or more administrations, including two, three, four, five or six administrations. One skilled in the art readily can determine the number of administrations to perform, or the desirability of performing one or more additional administrations, according to methods known in the art for monitoring therapeutic methods and other monitoring methods provided herein. Accordingly, the methods provided herein include methods of providing to the subject one or more administrations of immunostimulatory bacteria, where the number of administrations can be determined by monitoring the subject, and, based on the results of the monitoring, determining whether or not to provide one or more additional administrations. Deciding whether or not to provide one or more additional administrations can be based on a variety of monitoring results, including, but not limited to, indication of tumor growth or inhibition of tumor growth, appearance of new metastases or inhibition of metastasis, the subject's anti-bacterial antibody titer, the subject's anti-tumor antibody titer, the overall health of the subject and the weight of the subject.

The time period between administrations can be any of a variety of time periods. The time period between administrations can be a function of any of a variety of factors, including monitoring steps, as described in relation to the number of administrations, the time period for a subject to mount an immune response, the time period for a subject to clear bacteria from normal tissue, or the time period for bacterial colonization/proliferation in the tumor or metastasis. In one example, the time period can be a function of the time period for a subject to mount an immune response; for example, the time period can be more than the time period for a subject to mount an immune response, such as more than about one week, more than about ten days, more than about two weeks, or more than about a month; in another example, the time period can be less than the time period for a subject to mount an immune response, such as less than about one week, less than about ten days, less than about two weeks, or less than about a month. In another example, the time period can be a function of the time period for bacterial colonization/proliferation in the tumor or metastasis; for example, the time period can be more than the amount of time for a detectable signal to arise in a tumor or metastasis after administration of a microorganism expressing a detectable marker, such as about 3 days, about 5 days, about a week, about ten days, about two weeks, or about a month.

The methods used herein also can be performed by administering compositions, such as suspensions and other formulations, containing the immunostimulatory bacteria provided herein. Such compositions contain the bacteria and a pharmaceutically acceptable excipient or vehicle, as provided herein or known to those of skill in the art.

As discussed above, the uses and methods provided herein also can include administering one or more therapeutic compounds, such as anti-tumor compounds or other cancer therapeutics, to a subject in addition to administering immunostimulatory bacteria to the subject. The therapeutic compounds can act independently, or in conjunction with the immunostimulatory bacteria, for tumor therapeutic effects. Therapeutic compounds that can act independently include any of a variety of known chemotherapeutic compounds that can inhibit tumor growth, inhibit metastasis growth and/or formation, decrease the size of a tumor or metastasis, or eliminate a tumor or metastasis, without reducing the ability of the immunostimulatory bacteria to accumulate in a tumor, replicate in the tumor, and cause or enhance an anti-tumor immune response in the subject. Examples of such chemotherapeutic agents include, but are not limited to, alkylating agents such as thiotepa and cyclophosphamide; alkyl sulfonates such as busulfan, improsulfan and piposulfan; androgens such as calusterone, dromostanolone propionate, epitiostanol, mepitiostane, and testolactone; anti-adrenals such as aminoglutethimide, mitotane, and trilostane; anti-androgens such as flutamide, nilutamide, bicalutamide, leuprolide, and goserelin; antibiotics such as aclacinomycin, actinomycin, anthramycin, azaserine, bleomycin, cactinomycin, calicheamicin, carubicin, carminomycin, carzinophilin, chromomycin, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, porfiromycin, puromycin, quelamycin, rodorubicin, streptonigrin, streptozocin, tubercidin, ubenimex, zinostatin, and zorubicin; anti-estrogens including for example tamoxifen, raloxifene, aromatase inhibiting 4(5)-imidazoles, 4-hydroxytamoxifen, trioxifene, keoxifene, LY 117018, onapristone, and toremifene (Fareston); anti-metabolites such as methotrexate and 5-fluorouracil (5-FU); folic acid analogues such as denopterin, methotrexate, pteropterin, and trimetrexate; aziridines such as benzodepa, carboquone, meturedepa, and uredepa; ethylenimines and methylmelamines including altretamine, triethylenemelamine, triethylenephosphoramide, triethylenethiophosphoramide and trimethylol melamine; folic acid replenisher such as folinic acid; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, and uracil mustard; nitrosoureas such as carmustine, chlorozotocin, fotemustine, lomustine, nimustine, and ranimustine; platinum analogs such as cisplatin and carboplatin; vinblastine; platinum; proteins such as arginine deiminase and asparaginase; purine analogs such as fludarabine, 6-mercaptopurine, thiamiprine, and thioguanine; pyrimidine analogs such as ancitabine, azacitidine, 6-azauridine, carmofur, cytarabine, dideoxyuridine, doxifluridine, enocitabine, floxuridine, and 5-FU; taxanes, such as paclitaxel and docetaxel and albuminated forms thereof (i.e., nab-paclitaxel and nab-docetaxel), topoisomerase inhibitor RFS 2000; thymidylate synthase inhibitor (such as Tomudex); and additional chemotherapeutics including aceglatone; aldophosphamide glycoside; aminolevulinic acid; amsacrine; bestrabucil; bisantrene; edatrexate; defosfamide; demecolcine; diaziquone; difluoromethylornithine (DFMO); eflornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK (polysaccharide krestin); razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; chlorambucil; gemcitabine; 6-thioguanine; mercaptopurine; methotrexate; etoposide (VP-16); ifosfamide; mitomycin C; mitoxantrone; vincristine; vinorelbine; Navelbine; Novantrone; teniposide; daunomycin; aminopterin; Xeloda; ibandronate; CPT-11; retinoic acid; esperamycins; capecitabine; and topoisomerase inhibitors such as irinotecan. Pharmaceutically acceptable salts, acids or derivatives of any of the above can also be used.

Therapeutic compounds that act in conjunction with the immunostimulatory bacteria include, for example, compounds that increase the immune response eliciting properties of the bacteria. For example, a gene expression-altering compound can induce or increase transcription of a gene in a bacterium, such as an exogenous gene, such as a STING protein. Any of a wide variety of compounds that can alter gene expression are known in the art, including IPTG and RU486. Exemplary genes whose expression can be up-regulated include proteins and RNA molecules, including toxins, enzymes that can convert a prodrug to an anti-tumor drug, cytokines, transcription regulating proteins, shRNA, siRNA, and ribozymes. In other embodiments, therapeutic compounds that can act in conjunction with the immunostimulatory bacteria to increase the colonization/proliferation or immune response eliciting properties of the bacteria are compounds that can interact with a bacteria-expressed gene product, and such interaction can result in an increased killing of tumor cells or an increased anti-tumor immune response in the subject. A therapeutic compound that can interact with a bacteria-expressed gene product can include, for example a prodrug or other compound that has little or no toxicity or other biological activity in its subject-administered form, but after interaction with a bacteria-expressed gene product, the compound can develop a property that results in tumor cell death, including but not limited to, cytotoxicity, ability to induce apoptosis, or ability to trigger an immune response. A variety of prodrug-like substances are known in the art, including ganciclovir, 5-fluorouracil, 6-methylpurine deoxyriboside, cephalosporin-doxorubicin, 4-[(2-chloroethyl)(2-mesuloxyethyl)amino]benzoyl-L-glutamic acid, acetaminophen, indole-3-acetic acid, CB1954, 7-ethyl-10-[4-(1-piperidino)-1-piperidino]carbonyloxycamptothecin, bis-(2-chloroethyl)amino-4-hydroxyphenylaminomethanone 28, 1-chloromethyl-5-hydroxy-1,2-dihyro-3H-benz[e]indole, epirubicin-glucuronide, 5'-deoxy5-fluorouridine, cytosine arabinoside, and linamarin.

3. Monitoring

The methods provided herein can further include one or more steps of monitoring the subject, monitoring the tumor, and/or monitoring the immunostimulatory bacteria administered to the subject. Any of a variety of monitoring steps can be included in the methods provided herein, including, but not limited to, monitoring tumor size, monitoring the presence and/or size of metastases, monitoring the subject's lymph nodes, monitoring the subject's weight or other health indicators including blood or urine markers, monitoring anti-bacterial antibody titer, monitoring bacterial expression of a detectable gene product, and directly monitoring bacterial titer in a tumor, tissue or organ of a subject.

The purpose of the monitoring can be simply for assessing the health state of the subject or the progress of therapeutic treatment of the subject, or can be for determining whether or not further administration of the same or a different immunostimulatory bacterium is warranted, or for determining when or whether or not to administer a compound to the subject where the compound can act to increase the efficacy of the therapeutic method, or the compound can act to decrease the pathogenicity of the bacteria administered to the subject.

In some embodiments, the methods provided herein can include monitoring one or more bacterially expressed genes. Bacteria, such as those provided herein or otherwise known in the art, can express one or more detectable gene products, including but not limited to, detectable proteins.

As provided herein, measurement of a detectable gene product expressed in a bacterium can provide an accurate determination of the level of bacteria present in the subject. As further provided herein, measurement of the location of the detectable gene product, for example, by imaging methods including tomographic methods, can determine the localization of the bacteria in the subject. Accordingly, the methods provided herein that include monitoring a detectable bacterial gene product can be used to determine the presence or absence of the bacteria in one or more organs or tissues of a subject, and/or the presence or absence of the bacteria in a tumor or metastases of a subject. Further, the methods provided herein that include monitoring a detectable bacterial gene product can be used to determine the titer of bacteria present in one or more organs, tissues, tumors or metastases. Methods that include monitoring the localization and/or titer of bacteria in a subject can be used for determining the pathogenicity of bacteria since bacterial infection, and particularly the level of infection, of normal tissues and organs can indicate the pathogenicity of the bacteria. The methods that include monitoring the localization and/or titer of immunostimulatory bacteria in a subject can be performed at multiple time points and, accordingly, can determine the rate of bacterial replication in a subject, including the rate of bacterial replication in one or more organs or tissues of a subject; accordingly, methods that include monitoring a bacterial gene product can be used for determining the replication competence of the bacteria. The methods provided herein also can be used to quantitate the amount of immunostimulatory bacteria present in a variety of organs or tissues, and tumors or metastases, and can thereby indicate the degree of preferential accumulation of the bacteria in a subject; accordingly, the bacterial gene product monitoring can be used in methods of determining the ability of the bacteria to accumulate in tumor or metastases in preference to normal tissues or organs. Since the immunostimulatory bacteria used in the methods provided herein can accumulate in an entire tumor or can accumulate at multiple sites in a tumor, and can also accumulate in metastases, the methods provided herein for monitoring a bacterial gene product can be used to determine the size of a tumor or the number of metastases present in a subject. Monitoring such presence of bacterial gene product in a tumor or metastasis over a range of time can be used to assess changes in the tumor or metastases, including growth or shrinking of a tumor, or development of new metastases or disappearance of metastases, and also can be used to determine the rate of growth or shrinking of a tumor, or development of new metastases or disappearance of metastases, or the change in the rate of growth or shrinking of a tumor, or development of new metastases or disappearance of metastases. Accordingly, monitoring a bacterial gene product can be used for monitoring a neoplastic disease in a subject, or for determining the efficacy of treatment of a neoplastic disease, by determining rate of growth or shrinking of a tumor, or development of new metastases or disappearance of metastases, or the change in the rate of growth or shrinking of a tumor, or development of new metastases or disappearance of metastases.

Any of a variety of detectable proteins can be detected by monitoring, exemplary of which are any of a variety of fluorescence proteins (e.g., green fluorescence proteins), any of a variety of luciferases, transferrin or other iron binding proteins; or receptors, binding proteins, and antibodies, where a compound that specifically binds the receptor, binding protein or antibody can be a detectable agent or can be labeled with a detectable substance (e.g., a radionuclide or imaging agent).

Tumor and/or metastasis size can be monitored by any of a variety of methods known in the art, including external assessment methods or tomographic or magnetic imaging methods. In addition to the methods known in the art, methods provided herein, for example, monitoring bacterial gene expression, can be used for monitoring tumor and/or metastasis size.

Monitoring size over several time points can provide information regarding the increase or decrease in size of a tumor or metastasis, and can also provide information regarding the presence of additional tumors and/or metastases in the subject. Monitoring tumor size over several time points can provide information regarding the development of a neoplastic disease in a subject, including the efficacy of treatment of a neoplastic disease in a subject.

The methods provided herein also can include monitoring the antibody titer in a subject, including antibodies produced in response to administration of immunostimulatory bacteria to a subject. The bacteria administered in the methods provided herein can elicit an immune response to endogenous bacterial antigens. The bacteria administered in the methods provided herein also can elicit an immune response to exogenous genes expressed by the bacteria. The bacteria administered in the methods provided herein also can elicit an immune response to tumor antigens. Monitoring antibody titer against bacterial antigens, bacterially expressed exogenous gene products, or tumor antigens can be used to monitor the toxicity of the bacteria, the efficacy of treatment methods, or the level of gene product or antibodies for production and/or harvesting.

Monitoring antibody titer can be used to monitor the toxicity of the bacteria. Antibody titer against a bacteria can vary over the time period after administration of the bacteria to the subject, where at some particular time points, a low anti-(bacterial antigen) antibody titer can indicate a higher toxicity, while at other time points a high anti-(bacterial antigen) antibody titer can indicate a higher toxicity. The bacteria used in the methods provided herein can be immunogenic, and can, therefore, elicit an immune response soon after administering the bacteria to the subject. Generally, immunostimulatory bacteria against which the immune system of a subject can mount a strong immune response can be bacteria that have low toxicity when the subject's immune system can remove the bacteria from all normal organs or tissues. Thus, in some embodiments, a high antibody titer against bacterial antigens soon after administering the bacteria to a subject can indicate low toxicity of the bacteria.

In other embodiments, monitoring antibody titer can be used to monitor the efficacy of treatment methods. In the methods provided herein, antibody titer, such as anti-(tumor antigen) antibody titer, can indicate the efficacy of a therapeutic method such as a therapeutic method to treat neoplastic disease. Therapeutic methods provided herein can include causing or enhancing an immune response against a tumor and/or metastasis. Thus, by monitoring the anti-(tumor antigen) antibody titer, it is possible to monitor the efficacy of a therapeutic method in causing or enhancing an immune response against a tumor and/or metastasis.

In other embodiments, monitoring antibody titer can be used for monitoring the level of gene product or antibodies for production and/or harvesting. As provided herein, methods can be used for producing proteins, RNA molecules such as shRNA, or other compounds, by expressing an exogenous gene in a microorganism that has accumulated in a tumor. Monitoring antibody titer against the protein, RNA molecule or other compound can indicate the level of production of the protein, RNA molecule or other compound by the tumor-accumulated microorganism, and also can directly indicate the level of antibodies specific for such a protein, RNA molecule or other compound.

The methods provided herein also can include methods of monitoring the health of a subject. Some of the methods provided herein are therapeutic methods, including neoplastic disease therapeutic methods. Monitoring the health of a subject can be used to determine the efficacy of the therapeutic method, as is known in the art. The methods provided herein also can include a step of administering to a subject an immunostimulatory bacterium, as provided herein. Monitoring the health of a subject can be used to determine the pathogenicity of an immunostimulatory bacterium administered to a subject. Any of a variety of health diagnostic methods for monitoring disease such as neoplastic disease, infectious disease, or immune-related disease can be monitored, as is known in the art. For example, the weight, blood pressure, pulse, breathing, color, temperature or other observable state of a subject can indicate the health of a subject. In addition, the presence or absence or level of one or more components in a sample from a subject can indicate the health of a subject. Typical samples can include blood and urine samples, where the presence or absence or level of one or more components can be determined by performing, for example, a blood panel or a urine panel diagnostic test. Exemplary components indicative of a subject's health include, but are not limited to, white blood cell count, hematocrit, and c-reactive protein concentration.

The methods provided herein can include monitoring a therapy, where therapeutic decisions can be based on the results of the monitoring. Therapeutic methods provided herein can include administering to a subject immunostimulatory bacteria, where the bacteria can preferentially accumulate in a tumor and/or metastasis, and where the bacteria can cause or enhance an anti-tumor immune response. Such therapeutic methods can include a variety of steps including multiple administrations of a particular immunostimulatory bacterium, administration of a second immunostimulatory bacterium, or administration of a therapeutic compound. Determination of the amount, timing or type of immunostimulatory bacteria or compound to administer to the subject can be based on one or more results from monitoring the subject. For example, the antibody titer in a subject can be used to determine whether or not it is desirable to administer an immunostimulatory bacterium and, optionally, a compound, the quantity of bacteria and/or compound to administer, and the type of bacteria and/or compound to administer, where, for example, a low antibody titer can indicate the desirability of administering an additional immunostimulatory bacterium, a different immunostimulatory bacterium, and/or a therapeutic compound such as a compound that induces bacterial gene expression or a therapeutic compound that is effective independent of the immunostimulatory bacteria.

In another example, the overall health state of a subject can be used to determine whether or not it is desirable to administer an immunostimulatory bacterium and, optionally, a compound, the quantity of bacterium or compound to administer, and the type of bacterium and/or compound to administer where, for example, determining that the subject is healthy can indicate the desirability of administering additional bacteria, different bacteria, or a therapeutic compound such as a compound that induces bacterial gene expression. In another example, monitoring a detectable bacterially expressed gene product can be used to determine whether it is desirable to administer an immunostimulatory bacterium and, optionally, a compound, the quantity of bacterium and/or compound to administer, and the type of bacterium and/or compound to administer where, for example, determining that the subject is healthy can indicate the desirability of administering additional bacteria, different bacteria, or a therapeutic compound such as a compound that induces bacterial gene expression. Such monitoring methods can be used to determine whether or not the therapeutic method is effective, whether or not the therapeutic method is pathogenic to the subject, whether or not the bacteria have accumulated in a tumor or metastasis, and whether or not the bacteria have accumulated in normal tissues or organs. Based on such determinations, the desirability and form of further therapeutic methods can be derived.

In another example, monitoring can determine whether or not immunostimulatory bacteria have accumulated in a tumor or metastasis of a subject. Upon such a determination, a decision can be made to further administer additional bacteria, a different immunostimulatory bacterium and, optionally, a compound to the subject.

J. EXAMPLES

The following examples are included for illustrative purposes only and are not intended to limit the scope of the invention.

Summary of Exemplary Engineered Immunostimulatory Bacterial Strains and Nomenclature:

| Strain # | Plasmid | Strain Background | RNAi Targets | Alternate name |
|---|---|---|---|---|
| AST-100 | None | YS1646 | none | VNP20009 |
| AST-101 | None | YS1646-ASD | none | ASD (asd gene knockout) |
| AST-102 | pEQU6 | YS1646 | none | YS1646 (pEQU6 - plasmid) |
| AST-103 | pEQU6 | YS1646 | Scrambled (shRNA) | YS1646 (pEQU6-shSCR) |
| AST-104 | pEQU6 | YS1646 | muTREX1 (shRNA) ARI-108 | YS1646 (pEQU6-shTREX1) |
| AST-105 | pEQU6 | YS1646 | muPD-L1 (shRNA) ARI-115 | YS1646 (pEQU6-shPDL1) |
| AST-106 | pEQU6 | YS1646 | muTREX1 (microRNA) ARI-203 | YS1646 (pEQU6-miTREX1) |
| AST-107 | pATI-U6 | YS1646-ASD | Scrambled (shRNA) | ASD (pATI-shSCR) |
| AST-108 | pATI-U6 | YS1646-ASD | muTREX1 (shRNA) ARI-108 | ASD (pATI-shTREX1) |
| AST-109 | pATIKAN-U6 | YS1646-ASD | Scrambled (shRNA) | ASD (pATIKan-shSCR) |
| AST-110 | pATIKAN-U6 | YS1646-ASD | muTREX1 (shRNA) ARI-108 | ASD (pATIKan-shTREX1) |
| AST-111 | None | YS1646-ASD-fljb-fliC | None | ASD/FLG (asd and flagellin knockout) |
| AST-112 | pATI-U6 | YS1646-ASD-fljb-fliC | muTREX1 (shRNA) ARI-108 | ASD/FLG (pATI-shTREX1) |

-continued

| Strain # | Plasmid | Strain Background | RNAi Targets | Alternate name |
|---|---|---|---|---|
| AST-113 | pATI-U6 | YS1646-ASD-fljb-fliC | muTREX1 (shRNA) ARI-108 | ASD/FLG (pATI-U6 Kan shTREX1) |
| AST-114 | None | YS1646-ASD-LLO | None | ASD/LLO (asd knockout/ cytoLLO knock-in) |
| AST-115 | pATI-U6 | YS1646-ASD-LLO | muTREX1 (shRNA) ARI-108 | ASD/LLO (pATIKan-shTREX1) |
| AST-116 | pATIKanpBRori-U6 | YS1646-ASD | Scrambled | ASD (pATIKanLow-shSCR) |
| AST-117 | pATIKanpBRori-U6 | YS1646-ASD | muTREX1 (shRNA) ARI-108 | ASD (pATIKanLow-shTREX1) |
| AST-118 | pATIKanpBRori-U6 | YS1646-ASD-fljb-fliC | muTREX1 (shRNA) ARI-108 | ASD/FLG (pATIKanLow-shTREX1) |
| AST-119 | pATIKanpBRori-U6 | YS1646-ASD-pMTL-LLO | muTREX1 (shRNA) ARI-108 | ASD/LLO (pATIKanLow-shTREX1) |
| AST-120 | pEQU6 | YS1646-ASD-pMTL-LLO | muTREX1 (microRNA) ARI-203 | ASD/LLO(pEQU6-miTREX1) Suicidal |
| AST-121 | pEQU6 | YS1646 | muVISTA ARI-157 | YS1646 (pEQU6-shVISTA) |
| AST-122 | pEQU6 | YS1646 | muTGF-beta ARI-149 | YS1646 (pEQU6-TGF-beta) |
| AST-123 | pEQU6 | YS1645 | muBeta-Catenin ARI-166 | YS1646 (pEQU6-Beta-Catenin) |

Example 1

Auxotrophic Strains of *S. typhimurium*

The *Salmonella* Strain YS1646 is Auxotrophic for Adenosine

Strains provided herein are engineered to be auxotrophic for adenosine. As a result, they are attenuated in vivo because they are unable to replicate in the low adenosine concentrations of normal tissue, and colonization occurs primarily in the solid tumor microenvironment (TME), where adenosine levels are high. The *Salmonella* strain YS1646 is a derivative of the wild-type strain deposited under ATCC accession no. 14028, and was engineered to be auxotrophic for purines due to disruption of the purI gene (synonymous with purM) (Low et al. (2004) *Methods Mol. Med* 90:47-60). Subsequent analysis of the entire genome of YS1646 demonstrated that the purI gene was not in fact deleted, but was instead disrupted by a chromosomal inversion (Broadway et al. (2014) *J. Biotechnol.* 192:177-178), and that the entire gene is still contained within two parts of the YS1646 chromosome that is flanked by insertion sequences, one of which has an active transposase. The presence of the complete genetic sequence of the purI gene, disrupted by means of a chromosomal reengagement, leaves open the possibility of reversion to a wild-type gene. While it has previously been demonstrated that the purine auxotrophy of YS1646 was stable after >140 serial passages in vitro, it was not clear what the reversion rate is (Clairmont et al. (2000) *J. Infect. Dis.* 181:1996-2002).

It is shown herein that, when provided with adenosine, YS1646 is able to replicate in minimal medium, whereas the ATCC 14028 wild-type parental strain can grow in minimal medium that is not supplemented with adenosine. YS1646 was grown overnight in lysogeny broth (LB) medium, washed with M9 minimal medium, and diluted into M9 minimal medium containing no adenosine, or increasing concentrations of adenosine. Growth was measured using a SpectraMax® M3 Spectrophotometer (Molecular Devices LLC, San Jose, CA) at 37° C., reading the $OD_{600}$ every 15 minutes.

The results showed that, unlike the wild-type strain (ATCC #14028), which was able to grow in all concentrations of adenosine, the YS1646 strain only was able to replicate when adenosine was provided at concentrations ranging from 11 to 300 micromolar, but was completely unable to replicate in M9 alone or M9 supplemented with 130 nanomolar adenosine. These data demonstrate that purI mutants are able to replicate at concentrations of adenosine that are found in the tumor microenvironment, but not at concentrations found in normal tissues. Engineered adenosine auxotrophic strains exemplified herein include strains in which all or portions of the purI open reading frame are deleted from the chromosome to prevent reversion to wild-type. Such gene deletions can be achieved by any method known to one of skill in the art, including the lambda red system, as described below.

The *Salmonella* Strain YS1646 is Auxotrophic for ATP

In addition to the purine and adenosine auxotrophy, it was determined whether the purI deleted strain also can scavenge ATP. ATP accumulates to high levels in the tumor microenvironment, due to leakage from dying tumor cells. It is shown herein that, when provided with ATP, strain YS1646 is able to replicate in minimal media, but is unable to grow when not supplemented with ATP. To demonstrate this, strain YS1646 was grown overnight in LB medium, washed with M9 minimal medium, and diluted into M9 minimal medium containing no ATP, or increasing concentrations of ATP (Thermo Fisher Scientific, Waltham, MA). Growth was measured using a SpectraMax® M3 Spectrophotometer (Molecular Devices, San Jose, CA) at 37° C., reading the $OD_{600}$ every 15 minutes. The results demonstrated that strain YS1646 is able to replicate when ATP is provided at concentrations of 0.012 millimolar, or in M9 alone.

Example 2

Defects in Intracellular Replication are Attributed to the msbB Mutation

The YS1646 strain contains mutations in purI, which limits replication to sites containing high concentrations of purines, adenosine, or ATP, and in msbB, which alters the lipopolysaccharide (LPS) surface coat in order to reduce TLR4-mediated pro-inflammatory signaling. It also has been established that, unlike wild-type *Salmonella*, strain YS1646 is unable to replicate in macrophages. Experiments were performed to determine which of these genetic mutations is responsible for conferring that phenotype within the wild-type strain, ATCC 14028™.

In this assay, mouse RAW macrophage cells (InvivoGen, San Diego, Ca.) were infected with wild-type *Salmonella* strains containing deletions in purI, msbB, or both, at a multiplicity of infection (MOI) of approximately 5 bacteria per cell for 30 minutes, then the cells were washed with PBS, and medium containing gentamicin was added to kill extracellular bacteria. Intracellular bacteria are not killed by gentamicin, as it cannot cross the cell membrane. At various time points after infection, cell monolayers were lysed by osmotic shock with water, and the cell lysates were diluted and plated on LB agar to enumerate surviving colony forming units (CFUs).

As shown in the table below, wild-type *Salmonella* strains containing only the purI mutation still were able to replicate. This explains why there is only a modest improvement in tolerability observed with the purI deletion alone, while achieving a high degree of specificity to the tumor microenvironment. Strains containing only the msbB$^-$ mutation, as well as strains containing the purI$^-$ and msbB$^-$ mutations, were unable to replicate and were rapidly cleared from cells within 48 hours.

| | CFUs/Well | | | | | |
|---|---|---|---|---|---|---|
| Hours | Wild-type* ΔpurI | | Wild-type* ΔpurI/ΔmsbB | | Wild-type* ΔmsbB | |
| 1 | 104000 | 108000 | 68000 | 68000 | 88000 | 40000 |
| 2.5 | 5600 | 6000 | 760 | 960 | 3200 | 3200 |
| 5 | 5600 | 4000 | 1120 | 880 | 800 | 680 |
| 27 | 11200 | 5600 | 4 | 4 | 20 | 4 |

*wild-type ATCC accession number 14028

Example 3

*Salmonella* asd Gene Knockout Strain Engineering and Characterization

Strain YS1646Δasd was prepared. It is an attenuated *Salmonella typhimurium* strain derived from strain YS1646 (which can be purchased from ATCC, accession no. 202165) that has been engineered to have a deletion in the asd gene. In this example, the *Salmonella typhimurium* strain YS1646Δasd was engineered using modifications of the method of Datsenko and Wanner (*Proc. Natl. Acad. Sci. USA* 97:6640-6645 (2000)), as described below.

Introduction of the Lambda Red Helper Plasmid into Strain YS1646

The YS1646 strain was prepared to be electrocompetent as described previously (Sambrook J. (1998) *Molecular Cloning, A Laboratory Manual, 2nd edn.* Cold Spring Harbor, NY: Cold Spring Harbor Laboratory), by growing a culture in LB and concentrating 100-fold, and then washing three times with ice-cold 10% glycerol. The electrocompetent strain was electroporated with the Lambda red helper plasmid pKD46 (SEQ ID NO:218) using a 0.2 cm gap cuvette at the following settings: 2.5 kV, 186 ohms, 50 μF. Transformants carrying pKD46 were grown in 5 mL SOC medium with ampicillin and 1 mM L-arabinose at 30° C., and selected on LB agar plates containing ampicillin. A YS1646 clone containing the lambda red helper plasmid pKD46 then was made electrocompetent, as described above for strain YS1646.

Construction of asd Gene Knockout Cassette

The asd gene from the genome of strain YS1646 (Broadway et al. (2014) *J. Biotechnology* 192:177-178) was used for designing the asd gene knockout cassette. A plasmid containing 204 and 203 bp of homology to the left hand and right hand regions, respectively, of the asd gene, was transformed into DH5-alpha competent cells (Thermo Fisher Scientific). A kanamycin gene cassette flanked by lox P sites was cloned into this plasmid. The asd gene knockout cassette then was PCR amplified using primers asd-1 and asd-2 (Table 1) and gel purified.

Deletion of asd Gene

The YS1646 strain carrying plasmid pKD46 was electroporated with the gel-purified linear asd gene knock-out cassette. Electroporated cells were recovered in SOC medium and plated onto LB Agar plates supplemented with Kanamycin (20 μg/mL) and diaminopimelic acid (DAP, 50 μg/mL). During this step, lambda red recombinase induces homologous recombination of the chromosomal asd gene with the kan cassette (due to the presence of homologous flanking sequences upstream and downstream of the chromosomal asd gene), and knockout of the chromosomal copy of the asd gene occurs. The presence of the disrupted asd gene in the selected kanamycin resistant clones was confirmed by PCR amplification, with primers from the YS1646 genome flanking the sites of disruption (primer asd-3) and from the multi-cloning site (primer scFv-3) (Table 1). Colonies were also replica plated onto LB plates with and without supplemental DAP to demonstrate DAP auxotrophy. All clones with the asd gene deletion were unable to grow in the absence of supplemental DAP, demonstrating DAP auxotrophy.

TABLE 1

| Primer Information | | |
|---|---|---|
| Primer name | Primer sequence | SEQ. ID NO. |
| asd-1 | ccttcctaacgcaaattccctg | 219 |
| asd-2 | ccaatgctctgcttaactcctg | 220 |
| asd-3 | gcctcgccatgtttcagtacg | 221 |

TABLE 1-continued

| Primer Information | | |
|---|---|---|
| Primer name | Primer sequence | SEQ. ID NO. |
| asd-4 | ggtctggtgcattccgagtac | 222 |
| scFv-3 | cataatctgggtccttggtctgc | 223 |
| APR-001 | AAAAAAGCTTGCAGCTCTGGCCCGTG | 226 |
| APR-002 | AAAAAAGCTTTTAGAAAAACTCATCGAGCATCAAATGA | 227 |
| APR-003 | ACACTAGAAGgACAGTATTTGGTATCTG | 228 |
| APR-004 | AGCCGTAGTTAGGCCACC | 229 |
| flic-1 | CGTTATCGGCAATCTGGAGGC | 232 |
| flic-2 | CCAGCCCTTACAACAGTGGTC | 233 |
| flic-3 | GTCTGTCAACAACTGGTCTAACGG | 234 |
| flic-4 | AGACGGTCCTCATCCAGATAAGG | 235 |
| fljb-1 | TTCCAGACGACAAGAGTATCGC | 236 |
| fljb-2 | CCTTTAGGTTTATCCGAAGCCAGAATC | 237 |
| fljb-3 | CACCAGGTTTTTCACGCTGC | 238 |
| fljb-4 | ACACGCATTTACGCCTGTCG | 239 |
| pagp-1 | gcgtgacggttctgagtgct | 321 |
| pagp-2 | cgtctttgctgccatcttccg | 322 |
| pagp-3 | acaataacgacgactccgataagg | 323 |
| pagp-4 | ctgctgaatgtgctgattaacctg | 324 |
| ansb-1 | accttagaagatagccgcaaagc | 372 |
| ansb-2 | cagagacatgacacccacgattatc | 373 |
| ansb-3 | gcaaaccgctatccagaacga | 374 |
| ansb-4 | agtttaagtatgccgtggtactgc | 375 |
| csgd-1 | cacttgctttaagatttgtaatggctag | 317 |
| csgd-2 | ggtgtattcgctttcccatttgtc | 318 |
| csgd-3 | tgtgctgtccaggttaatgcc | 319 |
| csgd-4 | gacgacggttttctcgaagtctc | 320 |

Kanamycin Gene Cassette Removal

The kan selectable marker was removed by using the Cre/loxP site-specific recombination system. The YS1646Δasd gene Kan$^R$ mutant was transformed with pJW168, a temperature sensitive plasmid expressing the cre recombinase (SEQ ID NO:224). Amp$^R$ colonies were selected at 30° C.; pJW168 was subsequently eliminated by growth at 42° C. A selected clone was tested for loss of kan by replica plating on LB agar plates with and without kanamycin, and confirmed by PCR verification using primers from the YS1646 genome flanking the sites of disruption (primers asd-3 and asd-4, for primer sequence, see Table 1).

Confirmation of Functional asd Deletion Mutant Strain YS1646Δasd (Also Designated AST-101)

The Δasd mutant was unable to grow on LB agar plates at 37° C., but was able to grow on LB plates containing 50 μg/mL diaminopimelic acid (DAP). The Δasd mutant growth rate was evaluated in LB liquid media; it was unable to grow in liquid LB but was able to grow in LB supplemented with 50 μg/mL DAP, as determined by measuring absorbance at 600 nM.

Sequence Confirmation of the asd Locus Sequence in Strain YS1646Δasd after asd Gene Deletion The asd gene deletion strain was verified by DNA sequencing using primers asd-3 and asd-4. Sequencing of the region flanking the asd locus was performed and the sequence confirmed that the asd gene was deleted from the YS1646 chromosome.

Complementation of asd Deletion by asd Expression from Plasmids

A plasmid (pATIU6) was chemically synthesized and assembled (SEQ ID NO:225). The plasmid contained the following features: a high copy (pUC19) origin of replication, a U6 promoter for driving expression of a short hairpin, an ampicillin resistance gene flanked by HindIII restriction sites for subsequent removal, and the asd gene containing 85 base pairs of sequence upstream of the start codon (SEQ ID NO:246). Into this vector, shRNAs targeting murine TREX1 were introduced by restriction digestion with SpeI and XhoI and ligation and cloning into *E. coli* DH5-alpha cells. The resulting plasmid was designated pATI-shTREX1.

Electroporation of Plasmids into Immunostimulatory Bacterial Strains

Selected plasmids, containing expression cassettes encoding immunostimulatory proteins and a functional asd gene, were electroporated into *S. typhimurium* strains lacking the asd gene with a BTX600® electroporator using a 0.2 cm gap cuvette (BTX, San Diego, Calif.) at the following settings: 2.5 kV, 186 ohms, 50 μF. Electroporated cells were added to 1 mL SOC supplemented with 50 μM diaminopimelic acid (DAP), incubated for 1 hour at 37° C., and then spread onto agar plates that do not contain DAP, to select for strains that received plasmids with a functional asd gene. After single colony isolation, cell banks were produced by inoculating a flask of sterile lysogeny broth (LB) with a single well isolated colony of *S. typhimurium*, and incubating at 37° C. with agitation at 250 RPM. After the culture was grown to stationary phase, the bacteria were washed in PBS containing 10% glycerol, and stored in aliquots frozen at less than −60° C.

The plasmid pATI-shTREX1 was amplified in *E. coli* and purified for transformation into the YS1646Δasd strain by electroporation and clonal selection on LB amp plates, to produce the strain YS1646Δasd-shTREX1. The YS1646Δasd mutants complemented with pATIU6-derived plasmids were able to grow on LB agar and liquid media in the absence of DAP.

In a subsequent iteration, the ampicillin resistance gene (AmpR) from pATI-shTREX1 was replaced with a kanamycin resistance gene. This was accomplished by digestion of the pATI-shTREX1 plasmid with HindIII, followed by gel purification to remove the AmpR gene. The kanamycin resistance (KanR) gene was amplified by PCR using primers APR-001 and APR-002 (SEQ ID NO:226 and SEQ ID NO:227, respectively), followed by digestion with HindIII and ligation into the gel purified, digested pATIU6 plasmid.

In subsequent iterations, a single point mutation was introduced into the pATIKan plasmid at the pUC19 origin of replication using the Q5® Site-Directed Mutagenesis Kit (New England Biolabs) and the primers APR-003 (SEQ ID NO:228) and APR-004 (SEQ ID NO:229), to change the nucleotide T at position 148 to a C. This mutation makes the origin of replication homologous to the pBR322 origin of replication, which is a low copy origin of replication, in order to reduce the plasmid copy number.

Plasmid Maintenance Demonstrated In Vivo Using asd Complementation System

In this example, CT26 tumor-bearing mice were treated with strain YS1646 containing a plasmid that expresses an shRNA targeting TREX1 (YS1646-shTREX1), or an asd deleted strain of YS1646 containing a plasmid with a functional asd gene and an shRNA targeting TREX1 (YS1646Δasd-shTREX1).

CT26 (Colon Tumor #26) is a tumor model that originated from exposing BALB/c mice to N-nitro-N-methylurethane (NMU), resulting in a highly metastatic carcinoma that recapitulates the aggressive, undifferentiated and checkpoint-refractory human colorectal carcinoma (Castle et al. (2014) *BMC Genomics* 15(1):190). When implanted subcutaneously in the flank, as opposed to orthotopically in the colon, the tumor immunophenotype is much more immunosuppressive and checkpoint refractory. While largely lacking in T-cell infiltration, the tumor is rich in myeloid cells, such as macrophages and myeloid-derived suppressor cells (MDSCs) (Zhao et al. (2017) *Oncotarget* 8(33):54775-54787). As this model more closely resembles human microsatellite stable (MSS) colorectal cancer, it is an ideal model to evaluate the therapeutic approach provided herein.

For this experiment, 6-8 week-old female BALB/c mice (3 mice per group) were inoculated subcutaneously (SC) in the right flank with CT26 (purchased from ATCC, Manassas, VA) tumor cells ($2\times10^5$ cells in 100 μL PBS). Mice bearing 8 day-old established flank tumors were IV injected with three doses of $5\times10^6$ CFUs of the YS1646Δasd-shTREX1 strain or the parental strain YS1646 on days 8, 15 and 23. The plasmid encodes shTREX1 as an exemplary therapeutic product; any other desired therapeutic product or products can be substituted.

Body weights and tumors were measured twice weekly. Tumor measurements were performed using electronic calipers (Fowler, Newton, MA). Tumor volume was calculated using the modified ellipsoid formula, ½(length×width$^2$). Mice were euthanized when tumor size reached >20% of body weight or became necrotic, as per IACUC regulations.

At 12 days after the final *Salmonella* injection, tumors were homogenized, and homogenates were serially diluted and plated on LB agar plates, to enumerate the total number of colony forming units (CFUs) present, or on LB plates containing kanamycin, to enumerate the number of kanamycin resistant colonies.

The results demonstrated that *S. typhimurium* YS1646-shTREX1 did not have selective pressure to maintain the shRNA plasmid, and demonstrated significant plasmid loss, as the percent kanamycin resistant (KanR) colonies was less than 10%. The strain that used the asd gene complementation system for plasmid maintenance, YS1646Δasd-shTREX1, had nearly identical numbers of kanamycin resistant and kanamycin sensitive CFUs. These data demonstrate that the asd gene complementation system is sufficient to maintain the plasmid in the context of the tumor microenvironment in mice.

Enhanced Anti-Tumor Efficacy Using asd Complementation System

The asd complementation system is designed to prevent plasmid loss and potentiate the anti-tumor efficacy of the therapeutic product delivery by *S. typhimurium* strains in vivo. To test this, YS1646Δasd strains containing the shTREX1 plasmid (YS1646Δasd-shTREX1) or scrambled control (YS1646Δasd-shSCR) that contain a functional asd gene cassette were compared for anti-tumor efficacy in a murine colon carcinoma model, to strain YS1646 containing pEQU6-shTREX1 (YS1646-shTREX1), a plasmid that lacks an asd gene cassette, and therefore, does not have a mechanism for plasmid maintenance. shTREX1 is an exemplary therapeutic product.

For this experiment, 6-8 week-old female BALB/c mice (8 mice per group) were inoculated SC in the right flank with CT26 cells ($2\times10^5$ cells in 100 μL PBS). Mice bearing established flank tumors were IV injected twice, on day 8 and day 18, with $5\times10^6$ CFUs of YS1646Δasd-shTREX1 or YS1646-shTREX1, and compared to PBS control.

The YS1646-shTREX1 strain demonstrated enhanced tumor control compared to PBS (70% tumor growth inhibition (TGI), day 28) despite its demonstrated plasmid loss over time. The Δasd strain containing the plasmid with the asd gene complementation system and shTREX1 (YS1646Δasd-shTREX1) demonstrated superior tumor growth inhibition compared to PBS (82% TGI, p=0.002, day 25). These data demonstrate that improved potency is achieved by preventing plasmid loss, using the asd complementation system, and delivery of shTREX1, as compared to YS1646 containing plasmids without the asd gene complementation system. Thus, strains with asd complementation systems are superior anti-cancer therapeutics.

Example 4

Modified *S. typhimurium* Strains with Plasmids Containing CpG Elements Demonstrate Enhanced Anti-Tumor Activity Compared to the YS1646 Parental Strain Toll-like receptors (TLRs) are key receptors for sensing pathogen-associated molecular patterns (PAMPs) and activating innate immunity against pathogens (Akira et al. (2001) *Nat. Immunol.* 2(8):675-680). Of these, TLR9 is responsible for recognizing hypomethylated CpG motifs in pathogenic DNA which do not occur naturally in mammalian DNA (McKelvey et al. (2011) *J. Autoimmunity* 36:76). Recognition of CpG motifs upon phagocytosis of pathogens into endosomes in immune cell subsets induces IFR7-dependent type I interferon signaling and activates innate and adaptive immunity. It is shown herein, that the *S. typhimurium* strain YS1646 carrying modified *Salmonella typhimurium* plasmids containing CpG motifs (YS1646 pEQU6 Scramble) similarly activate TLR9 and induce type I IFN-mediated innate and adaptive immunity, as compared to the YS1646 strain without a plasmid.

The CpG motifs in the engineered plasmids used here are shown in Table 2. The pEQU6 shSCR (non-cognate shRNA) plasmid in strain AST-103 possesses 362 CpG motifs, indicating that *Salmonella*-based plasmid delivery can be immuno-stimulatory and have an anti-tumor effect, when compared to the same *Salmonella* lacking transformation with this plasmid. To assess the ability of CpG-containing plasmids within YS1646 to induce tumor growth inhibition in a murine colon carcinoma model, 6-8 week-old female BALB/c mice (9 mice per group) were inoculated SC in the right flank with CT26 cells ($2\times10^5$ cells in 100 μL PBS). Mice bearing established flank tumors were IV injected weekly with three doses of $5\times10^6$ CFUs of YS1646 (AST-100) or YS1646 containing an shRNA scrambled plasmid with CpG motifs (AST-103), and compared to PBS control.

TABLE 2

CpG motifs in the Engineered Plasmids

| Sequence Name | Number of CpG Motifs | SEQ ID NO. |
|---|---|---|
| pBR322 Origin | 80 | 243 |
| pEQU6 (shSCR) | 362 | 244 |
| Asd Gene ORF | 234 | 242 |
| pATI-2.0 | 538 | 245 |

The YS1646 (AST-100) strain demonstrated modest tumor control (32% TGI, p=ns, day 28) compared to PBS. The AST-103 strain, that varies from YS1646 only by the addition of the CpG-containing plasmid encoding a non-cognate scrambled shRNA, demonstrated highly significant tumor growth inhibition compared to YS1646 alone, untransformed and therefore lacking a plasmid (p=0.004, day 32).

The asd gene possesses 234 CpG motifs (see, Table 2), indicating that a plasmid containing it can have immunostimulatory properties. AST-109 (YS1646-ASD with scrambled shRNA) had 51% tumor growth inhibition vs. PBS alone, indicative of a strong immuno-stimulatory effect.

These data demonstrate the potent immunostimulatory properties of plasmid DNA containing TLR9-activating CpG motifs within a tumor-targeting attenuated strain of *S. typhimurium.*

Example 5

Vector Synthesis

Complementation of asd Deletion by asd Expression from Plasmids

A plasmid (pATIU6) was chemically synthesized and assembled (SEQ ID NO:225). The plasmid contains the following features: a high copy (pUC19) origin of replication, a U6 promoter for driving expression of a short hairpin, an ampicillin resistance gene flanked by HindIII restriction sites for subsequent removal, and the asd gene containing 85 base pairs of sequence upstream of the start codon (SEQ ID NO:246). Into this vector, shRNAs targeting murine TREX1 or a scrambled, non-cognate shRNA sequence were introduced by restriction digestion with SpeI and XhoI and ligation and cloning into *E. coli* DH5-alpha. The resulting plasmids, designated pATI-shTREX1 and pATI-shSCR, respectively, were amplified in *E. coli* and purified for transformation into the asd knockout strain AST-101 by electroporation and clonal selection on LB amp plates to produce strains AST-108, and AST-107, respectively. Alternatively, other nucleic acid molecules encoding other therapeutic products, including the gain-of-function variants of cytosolic DNA/RNA sensors described herein, are introduced into this vector. $asd^-$ mutants complemented with pATIU6-derived plasmids were able to grow on LB agar and liquid media in the absence of DAP.

In a subsequent iteration, the ampicillin resistance gene (AmpR) from pATI-shTREX1 was replaced with a kanamycin resistance gene. This was accomplished by digestion of pATI-shTREX1 plasmid with HindIII followed by gel purification to remove the AmpR gene, PCR amplification of the kanamycin resistance (KanR) gene using primers APR-001 and APR-002 (SEQ ID NO:226 and SEQ ID NO:227, respectively), digestion with HindIII and ligation into the gel purified, digested pATIU6 plasmid.

In subsequent iterations, a single point mutation was introduced into the pATIKan plasmid at the pUC19 origin of replication using the Q5® Site-Directed Mutagenesis Kit (New England Biolabs) and the primers APR-003 (SEQ ID NO:228) and APR-004 (SEQ ID NO:229) to change the nucleotide T at position 148 to a C. This mutation makes the origin of replication homologous to the pBR322 origin of replication in order to reduce the plasmid copy number.

| Primer ID | Description | Sequence | SEQ ID NO |
|---|---|---|---|
| APR-001 | Kan primerF | AAAAAAGCTTGCAGCTCTGGCCCGTG | 226 |
| APR-002 | Kan PrimerR | AAAAAAGCTTTTAGAAAAACTCATCGAGCATCAA ATGA | 227 |

-continued

| Primer ID | Description | Sequence | SEQ ID NO |
|---|---|---|---|
| APR-003 | pATI ori T148CF | ACACTAGAAGgACAGTATTTGGTATCTG | 228 |
| APR-004 | pATI ori T148CR | AGCCGTAGTTAGGCCACC | 229 |

pATI2.0

A plasmid was designed and synthesized that contains the following features: a pBR322 origin of replication, an SV40 DNA nuclear targeting sequence (DTS), an rrnB terminator, a U6 promoter for driving expression of shRNAs followed by flanking restriction sites for cloning the promoter and shRNAs or microRNAs, the asd gene, an rrnG terminator, a kanamycin resistance gene flanked by HindIII sites for curing, and a multicloning site (SEQ ID NO:247). In addition, a plasmid was designed and synthesized for expression of two separate shRNAs or microRNAs. This plasmid contains the following features: a pBR322 origin of replication, an SV40 DNA nuclear targeting sequence (DTS), an rrnB terminator, a U6 promoter for driving expression of shRNAs followed by flanking restriction sites for cloning the promoter and shRNAs or microRNAs, an H1 promoter for driving the expression of a $2^{nd}$ shRNA or microRNA, a 450 bp randomly generated stuffer sequence placed between the H1 and U6 promoters, the asd gene, an rrnG terminator, a kanamycin resistance gene flanked by HindIII sites for curing, and a multicloning site (SEQ ID NO:245).

Example 6

*S. typhimurium* Flagellin Knockout by Deletion of the fliC and fljB Genes Strain Engineering and Characterization In the example herein, the live attenuated *S. typhimurium* YS1646 strain containing the asd gene deletion was further engineered to delete the fliC and fljB genes, in order to remove both flagellin subunits. This eliminates pro-inflammatory TLR5 activation, in order to reduce pro-inflammatory signaling and improve anti-tumor adaptive immunity.

Deletion of fliC Gene

In this example, the fliC gene was deleted from the chromosome of the YS1646Δasd strain using modifications of the method of Datsenko and Wanner (*Proc. Natl. Acad. Sci. USA* 97:6640-6645 (2000)), as described in detail above. Briefly, synthetic fliC gene homology arm sequences, that contained 224 and 245 bases of homologous sequence flanking the fliC gene, were cloned into a plasmid called pSL0147 (SEQ ID NO:230). A kanamycin gene cassette flanked by cre/loxP sites then was cloned into pSL0147, and the fliC gene knockout cassette was then PCR amplified with primer flic-1 (SEQ ID NO:232) and flic-2 (SEQ ID NO:233), gel purified and then introduced into the YS1646Δasd strain carrying the temperature sensitive lambda red recombination plasmid pKD46 by electroporation. Electroporated cells were recovered in SOC+DAP medium and plated onto LB Agar plates supplemented with Kanamycin (20 μg/mL) and diaminopimelic acid (DAP, 50 μg/mL). Colonies were selected and screened for insertion of the knockout fragment by PCR using primers flic-3 (SEQ ID NO:234) and flic-4 (SEQ ID NO:235). pKD46 then was cured by culturing the selected kanamycin resistant strain at 42° C. and screening for loss of ampicillin resistance. The Kanamycin resistance marker then was cured by electroporation of a temperature sensitive plasmid expressing the Cre recombinase (pJW168) and $Amp^R$ colonies were selected at 30° C.; pJW168 was subsequently eliminated by growing cultures at 42° C. Selected fliC knockout clones were then tested for loss of the kanamycin marker by PCR, using primers flanking the sites of disruption (flic-3 and flic-4), and evaluation of the electrophoretic mobility on agarose gels.

Deletion of fljB Gene fljB was then deleted in the YS1646Δasd/ΔfliC strain using modifications of the methods described above. Synthetic fljB gene homology arm sequences that contained 249 and 213 bases of the left hand and right hand sequence, respectively, flanking the fljB gene, were synthesized and cloned into a plasmid called pSL0148 (SEQ ID NO:231). A kanamycin gene cassette flanked by cre/loxP sites then was cloned into pSL0148 and the fljB gene knockout cassette was PCR amplified with primers fljb-1 (SEQ ID NO:236) and fljb-2 (SEQ ID NO:237) (see, Table 1), gel purified and introduced into strain YS1646Δasd carrying the temperature sensitive lambda red recombination plasmid pKD46 by electroporation. The kanamycin resistance gene then was cured by cre-mediated recombination as described above, and the temperature-sensitive plasmids were cured by growth at non-permissive temperature. The fliC and fljB gene knockout sequences were amplified by PCR using primers flic-3 and flic-4, or fljb-3 (SEQ ID NO:238) and fljb-4 (SEQ ID NO:239), respectively, and verified by DNA sequencing. This mutant derivative of YS1646 was designated YS1646Δasd/ΔfliC/ΔfljB, or YS1646Δasd/ΔFLG for short.

In vitro Characterization of Engineered *S. typhimurium* Flagellin Knockout Strain The YS1646 derived $asd^-$ mutant strain harboring the deletions of both fliC and fljB, herein referred to as YS1646Δasd/ΔFLG, was evaluated for swimming motility by spotting 10 microliters of overnight cultures onto swimming plates (LB containing 0.3% agar and 50 mg/mL DAP). While motility was observed for the YS1646Δasd strain, no motility was evident with the YS1646Δasd/ΔFLG strain. The YS1646Δasd/ΔFLG strain then was electroporated with a plasmid containing an asd gene, and its growth rate in the absence of DAP was assessed. The YS1646Δasd/ΔFLG strain with an asd complemented plasmid was able to replicate in LB in the absence of supplemental DAP, and grew at a rate comparable to the YS1646Δasd strain containing an asd complemented plasmid. These data demonstrate that the elimination of flagellin does not decrease the fitness of *S. typhimurium* in vitro.

Elimination of Flagella Decreases Pyroptosis in Murine Macrophages $5\times10^5$ mouse RAW macrophage cells (InvivoGen, San Diego, Ca.) were infected with the YS1646Δasd/ΔFLG strain or the parental YS1646Δasd strain, both harboring an asd complemented plasmid, at an MOI of approximately 100 in a gentamicin protection assay. After 24 hours of infection, culture supernatants were collected and assessed for lactate dehydrogenase release as a marker of cell death, using a Thermo Scientific™ Pierce™ LDH Cytotoxicity Assay Kit (Thermo Fisher Scientific, Waltham, Ma.). The YS1646Δasd strain induced 75% maximal LDH release, while the YS1646Δasd/ΔFLG strain induced 54% maximal LDH release, demonstrating that deletion of the flagellin genes reduces the *S. typhimurium*-induced pyroptosis of infected macrophages.

Flagella-Deleted Mutants Lead to Less Pyroptosis in Infected Human Monocytes

To demonstrate that the YS1646Δasd/ΔFLG strains are reduced in their ability to cause cell death in macrophages, THP-1 human macrophage cells (ATCC accession no. 202165) were infected with the *S. typhimurium* strains YS1646 and YS1646Δasd/ΔFLG, with the Δasd strains containing plasmids encoding a functional asd gene to ensure plasmid maintenance. $5\times10^4$ cells were placed in a 96-well dish with DMEM and 10% FBS. Cells were infected with washed log-phase cultures of *S. typhimurium* for 1 hour at an MOI of 100 CFUs per cell, then the cells were washed with PBS, and the media was replaced with media containing 50 μg/mL gentamicin to kill extracellular bacteria, and 50 ng/ml of IFNγ to convert the monocytes into a macrophage phenotype. After 24 hours, the THP-1 cells were stained with CellTiter-Glo® reagent (Promega Corporation, Madison, WI) and the percentage of viable cells was determined using a luminescent cell viability assay using a SpectraMax® plate reader to quantify the luminescence. The cells infected with the YS1646 strain had only 38% viability, while the cells infected with the YS1646Δasd/ΔFLG strain had 51% viability, indicating that the deletion of the flagellin genes induced less cell death of human macrophages, despite a very high and supraphysiological MOI.

Flagella is not Required for Tumor Colonization after Systemic Administration

To assess the impact of the flagellin knockout strains, administered in a murine model of colon carcinoma, 6-8 week-old female BALB/c mice (5 mice per group) were inoculated SC in the right flank with CT26 cells ($2\times10^5$ cells in 100 μL PBS). Mice bearing 10-day established flank tumors were IV injected with a single dose of $3\times10^5$ CFUs of the YS1646Δasd/ΔFLG-shTREX1 strain or the parental YS1646Δasd-shTREX1 strain. At day 35 post tumor implantation, mice were euthanized, and tumors were homogenized and plated on LB plates to enumerate the number of colony forming units (CFUs) per gram of tumor tissue. The YS1646Δasd-shTREX1 strain colonized tumors at a mean of $5.9\times10^7$ CFUs per gram of tumor tissue, while the flagella-deleted YS1646Δasd/ΔFLG-shTREX1 strain colonized the tumors with almost a 2-fold increased mean of $1.1\times10^8$ CFUs/g of tumor tissue. The splenic colonization of the YS1646Δasd-shTREX1 strain was calculated as a mean of $1.5\times10^3$ CFU/g of spleen tissue, whereas splenic colonization of the flagella-deleted YS1646Δasd/ΔFLG-shTREX1 strain was slightly lower, at a mean of $1.2\times10^3$ CFU/g of spleen tissue.

These data demonstrate that the absence of flagella not only does not negatively impact tumor colonization after IV administration, but it enhances tumor colonization compared to the flagella-intact strain. Importantly, deletion of the flagella slightly reduces splenic colonization, giving a tumor to spleen ratio of 100,000-fold. These data demonstrate that, contrary to the expectation from the art, not only are the flagella not required for tumor colonization, but their elimination enhances tumor colonization while reducing splenic colonization.

The Flagella-Deleted Strain Demonstrates Enhanced Anti-Tumor Activity in Mice

To assess the impact of the flagellin knockout strains, administered in a murine model of colon carcinoma, 6-8 week-old female BALB/c mice (5 mice per group) were inoculated SC in the right flank with CT26 cells ($2\times10^5$ cells in 100 μL PBS). Mice bearing established flank tumors were IV injected with a single dose of $3\times10^5$ CFUs of the YS1646Δasd/ΔFLG-shTREX1 strain or the YS1646Δasd-shTREX1 strain, and compared to PBS control. Mice were monitored by caliper measurements for tumor growth.

The results demonstrated that the YS1646Δasd/ΔFLG-shTREX1 strain, incapable of making flagella, showed enhanced tumor control compared to the parental YS1646Δasd-shTREX1 strain (27% TGI, day 24), and significant tumor control compared to the PBS control (73% TGI, p=0.04, day 24). These data demonstrate that, not only is the flagella not required for tumor colonization, but its loss can enhance anti-tumor efficacy.

Flagella-Deleted Strains Demonstrate Enhanced Adaptive Immunity in a Murine Tumor Model The impact of deletion of the flagella on the immune response, and whether STING activation from tumor myeloid cell-delivery of shRNA to the STING checkpoint gene TREX1 would promote an adaptive type I IFN immune signature, was assessed. The CT26 murine model of colon carcinoma was used, where 6-8 week-old female BALB/c mice (5 mice per group) were inoculated SC in the right flank with CT26 cells ($2\times10^5$ cells in 100 μL PBS). Mice bearing established flank tumors were IV injected 11 days post tumor implantation with $5\times10^6$ CFUs of either the YS1646Δasd/ΔFLG-shTREX1 strain, the parental YS1646Δasd-shTREX1, or the scrambled plasmid control strain YS1646Δasd-shSCR, and compared to PBS control.

Mice were bled 7 days post dosing on Sodium Heparin coated tubes (sold under the trademark BD Vacutainer® Heparin Tubes, manufactured by (Becton, Dickinson and Company (BD Biosciences), Franklin Lakes, NJ). Non-coagulated blood was then diluted in the same volume of PBS and peripheral blood mononuclear cells (PBMCs) were separated from the interphase layer of whole blood using Lympholyte®-M cell separation reagent (Cedarlane Laboratories, Burlington, Canada). Isolated PBMCs were washed with PBS+2% FBS by centrifugation at 1300 RPM for 3 minutes at room temperature, and resuspended in flow buffer. One million PBMCs were seeded per well of a V-bottom 96-well plate. Cells were centrifuged at 1300 RPM for 3 minutes at room temperature (RT) and resuspended in 100 μL of flow buffer containing fluorochrome-conjugated AH1 peptide: MHC class I tetramers (MBL International), and the cell surface flow cytometry antibodies CD4 FITC clone RM4-5; CD8a BV421 clone 53-6.7; F4/80 APC clone BM8; CD11b PE-Cy7 clone M1/70; CD45 BV570 clone 30-F11; CD3 PE clone 145-2C11; Ly6C BV785 clone HK1.4; I-A/I-E APC-Cy7 clone M5/114.15.2; Ly6G BV605 clone 1A8; and CD24 PercP-Cy5.5 clone M1/69 (all from BioLegend, San Diego, CA), for 45 minutes at room temperature and in the dark. After 45 min, cells were washed twice with PBS+2% FBS by centrifugation at 1200 RPM for 3 min. Cells were then resuspended in PBS+2% FBS containing DAPI (dead/live staining) and data were immediately acquired using the NovoCyte® flow cytometer (ACEA Biosciences, Inc.) and analyzed using FlowJo™ software (Tree Star, Inc.).

The following cell types were enumerated as a percentage of total live cells: $CD11b^+$ $Gr1^+$ neutrophils (possibly MDSCs, although further phenotyping in an ex vivo functional assay would be required), $CD11b^+$ $F4/80^+$ macrophages, $CD8^+$ T-cells, and $CD8^+$ T-cells that recognize the CT26 tumor rejection antigen gp70 (AH1), the product of the envelope gene of murine leukemia virus (MuLV)-related cell surface antigen (Castle et al. (2014) *BMC Genomics* 15(1):190).

The results, summarized in the table below, show that the YS1646Δasd-shSCR strain, containing a plasmid encoding a non-specific scrambled shRNA, elicits the typical anti-bacterial immune profile of significantly increased neutrophils, as compared to PBS (p=0.02), to the flagella-intact YS1646Δasd-shTREX1 strain (p=0.02), and to the flagella-deleted strain YS1646Δasd/ΔFLG-shTREX1 (p=0.01), which had the lowest levels of circulating neutrophils. Similarly, bacterially-induced macrophages also were significantly elevated in response to the YS1646Δasd-shSCR strain, as compared to PBS (p=0.01), to the YS1646Δasd-shTREX1 strain (p=0.01), and to YS1646Δasd/ΔFLG-shTREX1 strain (p=0.01). Thus, both strains carrying type I IFN-inducing payloads were capable of overwriting the normal anti-bacterial immune response, which clears bacterial infections through neutrophils and macrophages, and does not induce adaptive T-cell-mediated immunity. However, while the overall circulating levels of $CD8^+$ T-cells were similar across all groups, the flagella-deleted YS1646Δasd/ΔFLG-shTREX1 strain demonstrated significantly increased percentages of AH1-tetramer$^+$ $CD8^+$ T-cells, as compared to PBS (p=0.04).

These data demonstrate the feasibility of engineering a bacteria to deliver viral-like type I IFN-inducing plasmids to tumor-resident myeloid cells. This results in a dramatic reprogramming of the immune response towards a more viral, and less bacterial, immune profile. Deletion of the flagella further enhanced the shift away from bacterially-recruited neutrophils and macrophages, and towards significantly increased tumor antigen-specific $CD8^+$ T-cells. Thus, eliminating bacterial TLR5-mediated inflammation can enhance adaptive immunity.

| | % Live Cells Mean ± SD | | | |
|---|---|---|---|---|
| Immune Cells | PBS | YS1646Δasd-shSCR | YS1646Δasd-shTREX1 | YS1646Δasd/ΔFLG-shTREX1 |
| Neutrophils | 6.27 ± 2.62 | 19.21 ± 9.46 | 5.87 ± 3.94 | 4.01 ± 1.65 |
| Macrophages | 10.08 ± 2.11 | 23.14 ± 9.04 | 9.12 ± 3.84 | 7.39 ± 2.11 |
| $CD8^+$ T-cells | 6.64 ± 0.56 | 7.17 ± 0.60 | 7.14 ± 2.30 | 6.44 ± 1.43 |
| $AH1^+$ $CD8^+$ T-cells | 0.83 ± 0.12 | 1.06 ± 1.11 | 2.27 ± 1.44 | 4.12 ± 3.08 |

Flagella-Deleted Strains are Restricted to the Phagocytic Myeloid Immune Cell Compartment In Vivo According to the literature, ΔfljB/ΔfliC strains demonstrate suppression of many downstream genes associated with SPI-1-mediated entry into non-phagocytic cells. In order to determine whether the YS1646Δasd/ΔFLG strain also is deficient for non-phagocytic cell uptake, a YS1646Δasd/ΔFLG strain, constitutively expressing mCherry under the bacterial rpsM promoter, was IV administered to MC38 subcutaneous flank tumor-bearing mice.

The MC38 (murine colon adenocarcinoma #38) model was derived similarly as the CT26 model using mutagenesis, but with dimethylhydrazine and in a C57BL/6 mouse strain (Corbett et al. (1975) *Cancer Res.* 35(9):2434-9). Similarly to CT26, subcutaneous implantation results in a more T-cell excluded and immunosuppressive tumor microenvironment than when implanted orthotopically in the colon (Zhao et al. (2017) *Oncotarget* 8(33):54775-54787). MC38 has a higher mutational burden than CT26, and a similar viral-derived gp70 antigen (p15E) can be detected by $CD8^+$ T-cells, although it is not considered a rejection antigen. While variants of MC38 have been found to be partially responsive to checkpoint therapy, most variants of the cell line are considered checkpoint refractory and T-cell excluded (Mariathasan et al. (2018) *Nature* 555:544-548), including the MC38 cells used herein.

6-8 week-old female C57BL/6 mice (5 mice per group) were inoculated SC in the right flank with MC38 cells ($5\times10^5$ cells in 100 μL PBS). Mice bearing large established flank tumors were IV injected on day 34 with $1\times10^6$ CFUs of the YS1646Δasd/ΔFLG-mCherry strain. Tumors were resected 7 days post IV dosing and cut into 2-3 mm pieces into gentleMACS™ C tubes (Miltenyi Biotec, Bergisch Gladbach, North Rhine-Westphalia, Germany) filled with 2.5 mL enzyme mix (RPMI-1640 10% FBS with 1 mg/mL Collagenase IV and 20 μg/mL DNase I). The tumor pieces were dissociated using OctoMACS™ (Miltenyi Bietee) Separator Kit specific dissociation program (mouse implanted tumors) (Miltenyi Biotec), and the whole cell preparation was incubated with agitation for 45 minutes at 37° C. After the 45 minute incubation, a second round of dissociation was performed using the OctoMACS™ Separator Kit (mouse implanted tumor program) and the resulting single cell suspensions were filtered through a 70 μM nylon mesh into a 50 mL tube. The nylon mesh was washed once with 5 mL of RPMI-1640 10% FBS, and the cells were filtered a second time using a new 70 μM nylon mesh into a new 50 mL tube. The nylon mesh was washed with 5 mL of RPMI-1640 10% FBS and the filtered cells were then centrifuged at 1000 RPM for 7 minutes. The resulting dissociated cells were resuspended in PBS and kept on ice before the staining process.

For the flow-cytometry staining, 100 μL of the single cell suspensions were seeded in wells of a V-bottom 96-well plate. PBS containing a Zombie Aqua™ dead/live stain (BioLegend) and Fc Blocking reagents (BD Biosciences) were added at 100 μL per well and incubated on ice for 30 minutes in the dark. After 30 minutes, cells were washed twice with PBS+2% FBS by centrifugation at 1300 RPM for 3 minutes. Cells were then resuspended in PBS+2% FBS containing fluorochrome-conjugated antibodies (CD4 FITC clone RM4-5; CD8a BV421 clone 53-6.7; F4/80 APC clone BM8; CD11b PE-Cy7 clone M1/70; CD45 BV570 clone 30-F11; CD3 PE clone 145-2C11; Ly6C BV785 clone HK1.4; I-A/I-E APC-Cy7 clone M5/114.15.2; Ly6G BV605 clone 1A8; and CD24 PercP-Cy5.5 clone M1/69, all from BioLegend), and incubated on ice for 30 minutes in the dark. After 30 minutes, cells were washed twice with PBS+2% FBS by centrifugation at 1300 RPM for 3 minutes and resuspended in flow cytometry fixation buffer (Thermo Fisher Scientific). Flow cytometry data were acquired using the NovoCyte® Flow Cytometer (ACEA Biosciences, Inc.) and analyzed using the FlowJo™ software (Tree Star, Inc.).

The results demonstrate that 7.27% of tumor infiltrating monocytes had taken up the flagella-deleted mCherry strain in the tumor microenvironment. Similarly, 8.96% of the tumor-associated macrophage (TAM) population, and 3.33% of the tumor-infiltrating dendritic cells (DCs) had taken up the flagella-deleted mCherry strain. In contrast, within the $CD45^-$ population, corresponding to stromal and tumor cells, only 0.076% showed positivity for mCherry expression (compared to 0.067% background staining). These data demonstrate that the flagella and its downstream signaling impact on SPI-1 are necessary to enable epithelial cell infectivity, and that the lack thereof restricts uptake of the bacteria to only the phagocytic immune cell compartment of the tumor microenvironment (i.e., tumor-resident immune/myeloid cells).

Deletion of the flagella confers multiple benefits to the immunostimulatory *S. typhimurium* strain, including eliminating TLR5-induced inflammatory cytokines that suppress adaptive immunity, reducing macrophage pyroptosis, as well as maintaining (or enhancing) tumor-specific enrichment upon systemic administration, where uptake is confined to tumor-resident phagocytic cells.

Example 7

*S. typhimurium* Engineered to Express cytoLLO for Enhanced Plasmid Delivery

In this example, the asd deleted strain of YS1646 described in Example 3 (AST-101) was further modified to express the listeriolysin O (LLO) protein lacking the signal sequence that accumulates in the cytoplasm of the *Salmonella* strain (referred to herein as cytoLLO). LLO is a cholesterol-dependent pore-forming cytolysin that is secreted from *Listeria monocytogenes* and mediates phagosomal escape of bacteria. A gene encoding LLO, with codons 2-24 deleted, was synthesized with codons optimized for expression in *Salmonella*. The sequence of the open reading frame (ORF) of cytoLLO is shown in SEQ ID NO:240. The cytoLLO gene was placed under control of a promoter that induces transcription in *S. typhimurium* (SEQ ID NO:241, reproduced below). The cytoLLO expression cassette was inserted in single copy into the knockout-out asd locus of the asd deleted strain AST-101, using modifications of the method of Datsenko and Wanner (*Proc Natl Acad Sci USA* (2000) 97:6640-6645), as described above.

| Sequence of promoter driving expression of cytoLLO | | |
|---|---|---|
| LLO promoter | attatgtcttgacatgtagtgagtgggctggtataatgcagcaag | SEQ ID NO: 241 |

The asd deleted strain with the cytoLLO expression cassette inserted at the asd locus (referred to herein as ASD/LLO or AST-114) was further modified by electroporation with a pATI plasmid encoding an asd gene that allows the strain to grow in the absence of exogenous DAP and selects for plasmid maintenance, and also contains a U6 promoter driving expression of shTREX1 as described above (referred to herein as ASD/LLO (pATI-shTREX1) or AST-115). The ASD/LLO (pATI-shTREX1) strain, AST-115, grew at a comparable rate to the asd deleted strain containing the same plasmid (pATI-shTREX1), AST-110, demonstrating that the LLO knock-in does not impact bacterial fitness in vitro.

*S. typhimurium* Engineered to Produce cytoLLO Demonstrates Potent Anti-Tumor Activity To determine whether the cytoLLO gene knock-in provided anti-tumor efficacy, the ASD/LLO (pATI-shTREX1) strain AST-115 was evaluated in a murine model of colon carcinoma. For this study, 6-8 week-old female BALB/c mice (8 mice per group) were inoculated SC in the right flank with CT26 cells ($2\times10^5$ cells in 100 PBS). Mice bearing established flank tumors were IV injected with a single dose of $5\times10^6$ CFUs of AST-115, and compared to PBS control.

Addition of the cytoLLO gene into the strain ASD/LLO (pATI-shTREX1) demonstrated highly significant tumor control compared to PBS control (76% TGI, p=0.002, day 28), and comparable efficacy after a single dose to previous studies where the TREX1 shRNA plasmid containing strains were given at multiple doses. These data demonstrate the cytoLLO-mediated advantage of delivering more plasmid into the cytosol, resulting in greater gene knockdown, thereby improving the therapeutic efficacy of RNAi against targets such as TREX1.

Example 8

Adenosine Auxotrophic Strains of *S. typhimurium*

Strains provided herein are engineered to be auxotrophic for adenosine. As a result, they are attenuated in vivo because they are unable to replicate in the low adenosine concentrations of normal tissue, therefore, colonization occurs primarily in the solid tumor microenvironment where adenosine levels are high. The *Salmonella* strain YS1646 (AST-100) is a derivative of the wild type strain (ATCC accession no. 14028), and was engineered to be auxotrophic for purine due to disruption of the purI gene (Low et al., (2004) *Methods Mol. Med* 90:47-60). Subsequent analysis of the entire genome of YS1646 demonstrated that the purI gene (synonymous with purM) was not in fact deleted, but was instead disrupted by a chromosomal inversion (Broadway et al. (2014) *J. Biotechnol.* 192:177-178), and that the entire gene is still contained within two parts of the YS1646 chromosome that is flanked by insertion sequences (one of which has an active transposase). The presence of the complete genetic sequence of the purI gene disrupted by means of a chromosomal reengagement leaves open the possibility of reversion to a wild type gene. While it has previously been demonstrated that purine auxotrophy of YS1646 was stable after serial passage in vitro, it was not clear what the reversion rate is (Clairmont et al. (2000) *J. Infect. Dis.* 181:1996-2002).

It is shown herein that, when provided with adenosine, YS1646 is able to replicate in minimal medium; whereas the wild-type parental strain (ATCC accession no. 14028) can grow in minimal media that is not supplemented with adenosine. YS1646 was grown overnight in LB medium washed with M9 minimal medium and diluted into M9 minimal media containing no adenosine, or increasing concentrations of adenosine. Growth was measured using a SpectraMax® M3 spectrophotometer (Molecular Devices) at 37° C., reading the $OD_{600}$ every 15 minutes.

YS1646 was able to replicate when adenosine was provided at concentrations ranging from 11 to 300 micromolar, but was completely unable to replicate in M9 alone or M9 supplemented with 130 nanomolar adenosine. These data demonstrate that purI mutants are able to replicate in concentrations of adenosine that are found in the tumor microenvironment, but not at concentrations found in normal tissues. Engineered adenosine auxotrophic strains exemplified herein include strains wherein all, or portions of the purI open reading frame are deleted from the chromosome to prevent reversion to wild-type. Such gene deletions can be achieved utilizing the lambda red system as described above.

*Salmonella* strains containing a purI disruption, further engineered to contain an asd gene deletion (ASD) as described above, or to contain an asd gene deletion and further engineered to have deletions of fliC and fljB (ASD/FLG) (as described in Example 6), or asd mutants further engineered to express cytoLLO (ASD/LLO) (as described in Example 7), and complemented with a low copy number plasmid (pATIlow) expressing asd (Strains AST-117, AST-118, and AST-119, respectively), were also evaluated for growth in M9 minimal media. The data show that each strain was able to replicate when adenosine was provided at concentrations ranging from 11 to 300 micromolar, but was completely unable to replicate in M9 alone or M9 supplemented with 130 nanomolar adenosine.

Example 9

Characterization and Use of the Asd Gene Complementation System In Vitro Growth of Strains with Asd Gene Complementation To assess fitness of the bacterial strains containing plasmids, growth curves were performed in LB liquid media using a SpectraMax® plate reader at 37° C., reading the $OD_{600}$ every 15 minutes. YS1646 containing a low copy plasmid pEQU6-shTREX1 (AST-104) grew comparably to YS1646 that did not contain a plasmid (AST-100). An asd mutant strain harboring a high copy shTREX1 plasmid with an asd gene that can complement the asd auxotrophy (AST-110) was able to replicate in LB in the absence of DAP, but grew slower than YS1646. An asd deleted strain containing an shTREX-1 expression plasmid with low copy number origin of replication and an asd gene that can complement the asd auxotrophy (pATIlow-shTREX1), strain AST-117, grew at a faster rate than AST-110. These data demonstrate that low copy number plasmids that complement the asd gene auxotrophy are superior to high copy number plasmids, as they allow for more rapid replication rates of *S. typhimurium* in vitro.

Intracellular Growth of asd Complemented Strains

To measure fitness of the asd mutants complemented with asd on high and low copy number plasmids, the ability of bacterial strains to replicate intracellularly in mouse tumor cell lines was assessed using a gentamicin protection assay. In this assay, mouse melanoma B16.F10 cells or mouse colon cancer CT26 cells were infected with asd mutant *Salmonella* strains containing plasmids that contain a complementary asd gene and have either a high copy origin of replication, AST-110 (ASD pATI-shTREX1), or a low copy origin of replication, AST-117 (ASD pATI low copy-shTREX1). Cells were infected at a multiplicity of approximately 5 bacteria per cell for 30 minutes, then cells were washed with PBS, and medium containing gentamicin was added to kill extracellular bacteria. Intracellular bacteria are not killed by gentamicin, as it cannot cross the cell membrane. At various time points after infection, cell monolayers were lysed by osmotic shock with water and the cell lysates were diluted and plated on LB agar to enumerate surviving colony forming units (CFU).

The asd mutant strain complemented with a high copy plasmid, AST-110, had an initial decline in CFUs, but was able to grow in B16.F10 cells but not in CT26 cells, demonstrating that the asd gene complementation system is sufficient to support growth inside mammalian tumor cells. The asd mutant strain containing the low copy plasmid, AST-117, was able to invade and replicate in both cell types, demonstrating that asd gene complementation on a low copy plasmid allows for robust asd mutant growth inside mammalian cells. The strain with low copy plasmids replicated to higher numbers in both tumor cell types compared to the strain with high copy plasmids. This demonstrates that *Salmonella* strains with low copy plasmids have enhanced fitness over strains with high copy plasmids.

Plasmid Maintenance in Tumors Using asd Complementation System

In this example, CT26 tumor-bearing mice were treated with YS1646 containing a plasmid that expresses an shRNA targeting TREX1 (pEQU6-TREX1), strain AST-104, or an asd deleted strain of YS1646 containing a plasmid with a functional asd gene and an shRNA targeting TREX1 (pATI-shTREX1), strain AST-110. At 12 days after the final *Salmonella* injection, tumors were homogenized, and homogenates were serially diluted and plated on LB agar plates to enumerate the total number of CFUs present, or on LB plates containing kanamycin to enumerate the number of kanamycin resistant colonies.

*S. typhimurium* that did not have selective pressure to maintain the shRNA plasmid, AST-104, demonstrated plasmid loss, as the percent kanamycin resistant (KanR) colonies was less than 10%. The strain that used the asd gene complementation system for plasmid maintenance, AST-110, had nearly identical numbers of kanamycin resistant and kanamycin sensitive CFUs. These data demonstrate that the asd gene complementation system is sufficient to maintain the plasmid in the context of the tumor microenvironment in mice.

Enhanced Anti-Tumor Efficacy Using asd Complementation System

The asd complementation system is designed to prevent plasmid loss and potentiate the anti-tumor efficacy of the inhibitory RNA delivery by *S. typhimurium* strains in vivo. To test this, asd deleted strains containing shTREX1 plasmid (AST-110) or scrambled control (AST-109) that contain a functional asd gene cassette were compared to strain YS1646 containing pEQU6-shTREX1 (AST-104, a plasmid that lacks an asd gene cassette and therefore does not have a mechanism for plasmid maintenance), for anti-tumor efficacy in a murine colon carcinoma model. For this experiment, 6-8 week-old female BALB/c mice (8 mice per group) were inoculated SC in the right flank with CT26 cells ($2\times10^5$ cells in 100 μL PBS). Mice bearing established flank tumors were IV injected twice, on day 8 and day 18, with $5\times10^6$ CFUs of AST-109 (ASD transformed with pATI-sh-Scramble), AST-110 (ASD transformed with pATI-shTREX1), or AST-104 (YS1646 transformed with pEQU6-shTREX1) and compared to PBS control.

The YS1646 strain AST-104 demonstrated tumor control compared to PBS (70% TGI, day 28) despite its demonstrated plasmid loss over time. The asd$^-$ strain containing the scramble control in a pATI plasmid with the asd gene complementation system (AST-109) demonstrated tumor control compared to PBS (51% TGI, day 25), indicating that maintained delivery of CpG plasmids stimulates an anti-tumor response. The asd⁻ strain containing a plasmid with the asd gene complementation system and shTREX1 (AST-110) demonstrated the highest tumor growth inhibition compared to PBS (82% TGI, p=0.002, day 25). These data demonstrate that improved potency is achieved by preventing plasmid loss using the asd complementation system and delivery of shTREX1, as compared to YS1646 containing plasmids without gene complementation systems or shTREX1 (the therapeutic product).

*S. typhimurium* Strains with Low Copy Plasmids Demonstrate Superior Anti-Tumor Efficacy and Tumor Colonization Compared to Strains with High Copy Plasmids In order to compare the anti-tumor efficacy of the low copy shTREX1 plasmid with the asd complementation system, relative to the high copy shTREX1 plasmid, in a murine model of colon carcinoma, 6-8 week-old female BALB/c mice (10 mice per group) were inoculated SC in the right flank with CT26 cells ($2\times10^5$ cells in 100 PBS). Mice bearing established flank tumors were IV injected with two weekly doses of $5\times10^6$ CFUs of AST-117 (ASD (pATI Low-shTREX1)) or AST-110 (ASD (pATI-shTREX1) and were compared to PBS injections as a negative control. The strain with the low copy plasmid, AST-117, demonstrated superior anti-tumor efficacy compared to the strain with the high copy plasmid, AST-110 (High, 59% TGI; Low 79% TGI, p=0.042, day 25).

At the end of this tumor growth inhibition study, 4 mice from each group were euthanized, and tumors and spleens were homogenized as described above to evaluate tumor colonization and tumor to spleen colonization ratios. The strain containing the low copy plasmid, AST-117, colonized tumors at a level greater than 100 times higher than the strain with the high copy plasmid, AST-110. When the ratio of colonies recovered from tumor and spleen were calculated, AST-117 had a greater than 10-fold higher tumor to spleen colonization ratio compared to AST-110, demonstrating that strains with the low copy plasmids have greater specificity for tumor colonization than strains with the high copy plasmids.

These data demonstrate a previously unknown attribute that *S. typhimurium* engineered to deliver plasmids have improved tumor colonizing capabilities and anti-tumor activity.

Example 10

Exemplary Strains Engineered for Increased Tolerability adrA or csgD Deletion

In this example, a live attenuated strain of *Salmonella typhimurium* that contains a purI deletion, an msbB deletion, an asd gene deletion and is engineered to deliver plasmids encoding interfering RNA, is further modified to delete adrA, a gene required for *Salmonella typhimurium* biofilm formation. *Salmonella* that cannot form biofilms are taken up more rapidly by host phagocytic cells and are cleared more rapidly. This increase in intracellular localization enhances the effectiveness of plasmid delivery and gene knockdown by RNA interference. The increased clearance rate from tumors/tissues increases the tolerability of the therapy, and the lack of biofilm formation prevents colonization of prosthetics and gall bladders in patients.

In another example, a live attenuated strain of *Salmonella typhimurium* that contains a purI deletion, an msbB deletion, an asd gene deletion and is engineered to deliver plasmids encoding a therapeutic product also is modified to delete csgD (engineering of strains with csgD deletion is described below). This gene is responsible for the activation of adrA, and also induces expression of the curli fimbriae, a TLR2 agonist. Loss of csgD also prevents biofilm formation, with the added benefit of inhibiting TLR2 activation, thereby further reducing the bacterial virulence and enhancing delivery of encoded therapeutic products.

pagP Deletion

In this example, a live attenuated strain of *S. typhimurium* that contains a purI deletion, an msbB deletion, and an asd gene deletion, and that is engineered to deliver plasmids encoding interfering RNA, is further modified to delete pagP. The pagP gene is induced during the infectious life cycle of *S. typhimurium* and encodes an enzyme that palmitoylates lipid A. In wild type *S. typhimurium*, expression of pagP results in a lipid A that is hepta-acylated. In an msbB⁻ mutant in which the terminal acyl chain of the lipid A cannot be added, the expression of pagP results in a hexa-acylated LPS. Hexa-acylated LPS has been shown to be the most pro-inflammatory. In this example, a strain deleted of pagP and msbB can produce only penta-acylated LPS, allowing for lower pro-inflammatory cytokines, enhanced tolerability, and increased adaptive immunity when the bacteria are engineered to deliver interfering RNAs or other therapeutic products.

Example 11 pagP Deletion Mutants have Penta-acylated LPS and Induce Reduced Inflammatory Cytokines

*Salmonella* pagP Gene Knockout Strain Engineering and Characterization

The pagP gene was deleted from the YS1646Δasd/ΔFLG strain using modifications of the methods described in the preceding examples. The pagP gene is induced during the infectious life cycle of *S. typhimurium* and encodes an enzyme (lipid A palmitoyltransferase) that modifies lipid A with palmitate. In wild-type *S. typhimurium*, expression of pagP results in a lipid A that is hepta-acylated. In an msbB⁻ mutant, in which the terminal acyl chain of lipid A cannot be added, the expression of pagP results in a hexa-acylated LPS. Hexa-acylated LPS has been shown to be highly pro-inflammatory and have a high affinity for TLR4 (hepta-acylated LPS, found in wild-type, has the highest affinity for TLR4). In this example, a strain deleted of pagP and msbB can produce only penta-acylated LPS, allowing for lower pro-inflammatory cytokines due to low affinity for TLR4, enhanced tolerability, and increased adaptive immunity when the bacteria are engineered to deliver plasmids encoding immunomodulatory proteins.

ΔpagP Strain Construction

Synthetic pagP gene homology arm sequences that contain 203 and 279 bases of the left hand and right hand sequence, respectively, flanking the pagP gene, were synthesized and cloned into a plasmid called pSL0191 (SEQ ID NO:315). A kanamycin gene cassette flanked by cre/loxP sites then was cloned into pSL0191 and the pagP gene knockout cassette was PCR amplified with primers pagp-1 (SEQ ID NO:321) and pagp-2 (SEQ ID NO:322) (see, Table 1), gel purified and introduced into strain YS1646Δasd carrying the temperature sensitive lambda red recombination plasmid pKD46 by electroporation. The kanamycin resistance gene then was cured by cre-mediated recombination as described above, and the temperature-sensitive plasmids were cured by growth at non-permissive temperature. The pagP gene knockout sequences were amplified by PCR using primers pagp-3 (SEQ ID NO:323) and pagp-4 (SEQ ID NO:324), and verified by DNA sequencing. The resulting mutant derivative of YS1646 was designated YS1646Δasd/ΔFLG/ΔpagP.

pagP Deletion Mutants have Penta-Acylated LPS and Induce Reduced Inflammatory Cytokines The pagP gene also was deleted from the YS1646Δasd strain using the lambda-derived Red recombination system as described in Datsenko and Wanner (*Proc. Natl. Acad. Sci. USA* 97:6640-6645 (2000)) and above, to generate the strain YS1646Δasd/ΔpagP. This strain then was electroporated with a plasmid containing a functional asd gene, to complement the deleted asd gene and to ensure plasmid maintenance in vivo. The lipid A then was extracted from this strain and evaluated by Matrix-Assisted Laser Desorption/Ionization Mass Spectrometry (MALDI MS) and compared to lipid A from the wild-type *S. typhimurium* strain (ATCC accession no. 14028), the YS1646 strain (which is $msbB^-$ and $purI^-$), and the YS1646Δasd strain. Wild-type *Salmonella* had a minor lipid A peak with a mass of 2034, and a major peak with a mass of 1796, corresponding to the hepta-acylated and hexa-acylated species, respectively, due to the presence of a functional msbB gene. The msbB deleted strains YS1646 and YS1646Δasd had major peaks at 1828 and 1585, corresponding to a mixture of hexa-acylated and penta-acylated LPS. The msbB and pagP deleted strain, YS1646Δasd/ΔpagP, had only a single peak with a mass of 1585, corresponding to penta-acylated LPS. These data demonstrate that deletion of pagP prevents palmitoylation of the LPS, thereby restricting it to a single penta-acylated species.

To show that the penta-acylated LPS from the ΔpagP mutant strains reduced TLR4 signaling, 4 μg of purified LPS from the wild-type strain, the YS1646 strain or the YS1646Δasd/ΔpagP strain were added to THP-1 human monocytic cells, and the supernatants were evaluated 24 hours later for the presence of inflammatory cytokines using a BD® Cytometric Bead Array (CBA) kit (BD Biosciences). The results show that LPS from the YS1646Δasd/ΔpagP strain induced 25% the amount of TNFα compared to wild-type LPS, and induced 7-fold less IL-6 than wild-type LPS. The LPS from the YS1646Δasd/ΔpagP strain induced 22-fold less IL-6 than strain YS1646, demonstrating that the penta-acylated LPS species from a ΔpagP mutant is significantly less inflammatory in human cells, and indicating that the ΔpagP mutant would be better tolerated in humans.

Deletion of pagP Induces Significantly Less IL-6 in Primary Human M2 Macrophages To demonstrate that the YS1646Δasd/ΔFLG/ΔpagP strain also elicits less inflammatory and dose-limiting IL-6 from primary human M2 macrophages, the strain was evaluated and compared with the YS1646Δasd/ΔFLG and the parental YS1646 strains. The M2 macrophages derived from human donors are representative of the immunosuppressive phenotypes that are highly enriched in T-cell excluded solid tumors. Frozen human PBMCs, isolated from healthy human donors, were thawed in complete medium (RPMI-1640+1× non-essential amino acids+5% human AB serum) and washed by centrifugation for 10 minutes at 800 RPM at room temperature. PBMCs were resuspended in PBS+2% FBS, and monocytes were negatively isolated using a CD16 depletion kit (STEMCELL Technologies, Inc.). Isolated untouched monocytes were then washed by centrifugation in PBS+2% FBS and resuspended in complete medium containing 100 ng/mL human macrophage colony-stimulating factor (M-CSF) and 10 ng/mL human IL-4. Isolated monocytes (3e5 per well) were then seeded in a 24-well plate with a final volume of 750 μL. Two days after seeding, the cell culture media was entirely aspirated and replaced with fresh complete medium containing 100 ng/ml human M-CSF and 10 ng/mL human IL-4. Two days later (on day 4), 500 μL of complete medium containing the cytokines was added per well for 48 hours. On day 6, the cell culture media was entirely aspirated and replaced with fresh complete medium without cytokines alone, or with media containing the log-phase cultures of the *S. typhimurium* strains at an MOI of 20. Cells were infected for 1 hour, then washed with PBS, and the media was replaced with fresh media containing 50 μg/mL gentamicin to kill extracellular bacteria. The wells were then washed and replaced with fresh media and allowed to incubate at 37° C. and 5% $CO_2$. After 48 hours, supernatants were harvested and assayed for cytokines using a human IL-6 BD® Cytometric Bead Array (CBA) according to manufacturer's instructions (BD Biosciences).

The results demonstrate that secreted IL-6 levels from human primary M2 macrophages, infected with parental strain YS1646, yielded an average of 14839±926 pg/mL, while the IL-6 levels from the YS1646Δasd/ΔFLG strain were significantly lower, at 2075±723 pg/mL (p=0.004). This further affirms the impact that the deletion of flagella, and elimination of TLR5 signaling, has on the induction of IL-6. The strain YS1646Δasd/ΔFLG/ΔpagP elicited the lowest IL-6 levels, at 332±100 pg/mL, demonstrating the reduced ability of this modified LPS coating to stimulate TLR4, and the resulting dramatically reduced inflammatory IL-6 production.

The Combined Flagella and pagP Deletions Significantly Enhance Tolerability in Mice To show that the modified strains described above are more attenuated than parental strain YS1646, a median lethal dose ($LD_{50}$) study was conducted. 6-8 week-old BALB/c mice (5 mice per group) were injected intravenously with a dose range of 3e5 to 3e7 CFUs of strain YS1646, or the derivative strains YS1646Δasd/ΔFLG, YS1646Δasd/ΔpagP, and YS1646Δasd/ΔFLG/ΔpagP. Unlike strain YS1646, the derivative strains also carried a plasmid encoding murine IL-2, an FDA-approved cytokine that has demonstrated significant toxicity when systemically administered. The $LD_{50}$ for strain YS1646 was found to be $4.4\times10^6$ CFUs (average of two studies), in line with previously published $LD_{50}$ reports of YS1646, and a >1000-fold improvement compared to wild-type *S. typhimurium* (Clairmont et al. (2000) *J. Infect. Dis.* 181:1996-2002). The $LD_{50}$ for the YS1646Δasd/ΔFLG strain was determined to be $2.07\times10^7$ CFUs, demonstrating a greater than 4.5-fold reduction in virulence compared to strain YS1646. The $LD_{50}$ for the YS1646Δasd/ΔpagP strain was determined to be $1.39\times10^6$ CFUs, demonstrating a 3.2-fold reduction in virulence, which is expected, given that the strain still has a highly inflammatory flagella. The $LD_{50}$ for the YS1646Δasd/ΔFLG/ΔpagP strain could not be established, as no mice died at the highest dose given, but was $>6.2\times10^7$ CFUs. The YS1646Δasd/ΔFLG/ΔpagP strain therefore demonstrates a >14-fold reduction in virulence compared to parental strain YS1646. These data demonstrate that the genetic modifications described above reduce the virulence of the clinical *S. typhimurium* strain YS1646, and therefore, lead to increased tolerability in humans.

In the Phase I clinical trial of VNP20009 (Toso et al. (2002) *J. Clin. Oncol.* 20(1):142-152), the presence of the bacteria in patients' tumors only partially was observed at the two highest doses tested, $3\times10^8$ CFU/$m^2$ (33% presence), and $1\times10^9$ CFU/$m^2$ (50% presence), indicating that the tolerable dose of VNP20009 was too low to achieve tumor colonization. By improving the tolerability of the strains through the modifications described above, >14-fold higher doses can be administered, if necessary, improving the percentage of patients whose tumors will be colonized, and increasing the level of therapeutic colonization per tumor, thereby solving the observed problems with VNP20009.

The Combined Flagella and PagP Deletions Significantly Limit the Generation of Anti-*S. typhimurium* Antibodies in Mice The surviving mice from the $3\times10^6$ CFU dosing group (N=5, except for N=4 in the YS1646 dosing group) were kept for 40 days post IV dosing, at which time they were bled for serum and assessed for antibody titers to *S. typhimurium* by a modified flow-based antibody titering system. Overnight cultures of the strain YS1646Δasd/ΔFLG-mCherry were washed and fixed with flow cytometry fixation buffer. Sera from previously-treated mice and from naïve control mice were seeded in a 96-well plate, and serial dilutions were performed in PBS. Next, 25 μL of the YS1646Δasd/ΔFLG-mCherry cultures, containing $1\times10^6$ CFUs, were added to the sera and incubated for 25 min at RT. The bacteria were then washed twice with PBS by spinning them at 4000 RPM for 5 min. After the last wash, the bacteria were resuspended in PBS containing a secondary Goat anti-Mouse Fc AF488 Ab (1/400 dilution from stock) and incubated for 25 minutes at RT and protected from light. The bacteria were then washed three times with PBS by spinning them at 4000 RPM for 5 min. After the last wash, the bacteria were resuspended in PBS and data were acquired using the NovoCyte® flow cytometer (ACEA Biosciences, Inc.) and analyzed using the MFI FlowJo™ software (Tree Star, Inc.).

To evaluate the results by flow cytometry, the highest dilution with signal in all groups was chosen (the 1250× serum dilution), and the corresponding mean fluorescence intensity (MFI) values were plotted. The limit of detection (LOD) was chosen at an MFI of 1000, as that is the MFI obtained without staining, as well as with background staining with Goat anti-Mouse Fc AF488 Ab only. Therefore, an MFI greater than 1000 was considered a positive signal, and everything equal to or under this value was considered a negative result, despite having an MFI value.

The results of this assay reveal a high MFI titer of anti-*S. typhimurium* serum antibodies from mice treated with $3\times10^6$ CFUs of the YS1646 strain (29196.3±20730), in line with previously published data that YS1646 is able to generate serum antibodies (that are non-neutralizing). Fewer antibodies were detected in the mice treated with the YS1646Δasd/ΔFLG strain (11257±9290), which can be due to the lack of adjuvant activity from the flagella. In the mice treated with the YS1646Δasd/ΔpagP strain, significantly fewer antibodies were generated (4494±3861), as compared to strain YS1646 (p=0.033), which can be due to the altered LPS surface coating. The most significant reduction in serum antibodies was demonstrated in the YS1646Δasd/ΔFLG/ΔpagP treatment group (1930±2445), where several of the mice had MFI titers under 1000, and were thus considered negative for serum antibodies (p=0.021, vs. strain YS1646). Thus, the combined deletions of the flagella and the pagP gene enable both improved safety, as well as significantly reduced immunogenicity, which will enable repeat dosing of high CFUs in humans.

pagP and Flagella Deleted Strains, and Their Combination, Demonstrate Significantly Higher Viability in Human Serum Compared to YS1646

Strain YS1646 (VNP20009) exhibits limited tumor colonization in humans after systemic administration. It is shown herein that strain YS1646 is inactivated by complement factors in human blood. To demonstrate this, strains YS1646 and *E. coli* D10B were compared to exemplary immunostimulatory bacteria provided herein, that contain additional mutations that alter the surface of the bacteria. These exemplary modified strains were YS1646Δasd/ΔpagP, YS1646Δasd/ΔFLG, and YS1646Δasd/ΔFLG/ΔpagP. These three strains, in addition to YS1646 and *E. coli* D10B cultures, were incubated with serum or heat-inactivated (HI) serum from either pooled mouse blood, or pooled healthy human donors (n=3), for 3 hours at 37° C. After incubation with serum, bacteria were serially diluted and plated on LB agar plates, and the colony forming units (CFUs) were determined.

In mouse serum, all strains remained 100% viable and were completely resistant to complement inactivation. In human serum, all strains were 100% viable in the heat-inactivated serum. The *E. coli* D10B strain was completely eliminated after 3 hours in whole human serum. In whole human serum, the YS1646 strain exhibited only 6.37% of live colonies, demonstrating that tumor colonization of the YS1646 clinical strain was limited due to complement inactivation in human blood. For the YS1646Δasd/ΔFLG strain, 31.47% of live colonies remained, and for the YS1646Δasd/ΔpagP strain, 72.9% of live colonies remained, after incubation with human serum for 3 hours. The combined YS1646Δasd/ΔFLG/ΔpagP strain was completely resistant to complement in human serum.

These data explain why strain YS1646 (VNP20009) has very low tumor colonization when systemically administered. It is shown herein that strain YS1646 is highly sensitive to complement inactivation in human serum, but not mouse serum. These data explain why limited tumor colonization was observed in humans, while mouse tumors were colonized at a high level. The fljB/fliC or pagP deletions, or the combination of these mutations, partially or completely rescues this phenotype. Thus, the enhanced stability observed in human serum with the YS1646Δasd/ΔpagP, YS1646Δasd/ΔFLG, and YS1646Δasd/ΔFLG/ΔpagP strains provides for increased human tumor colonization.

These data, and others provided herein, show that deletion of the flagella and/or pagP increases tumor colonization, improves tolerability, and increases the anti-tumor activity of the immunostimulatory bacteria. For example, it is shown herein that LPS from immunostimulatory bacteria that are $pagP^-$ induced 22-fold less IL-6 than LPS from YS1646, and therefore are less inflammatory in human cells. Additionally, each and all of FLG, hilA and pagP deletion mutants are more attenuated than YS1646 (see Example 12, below). Immunostimulatory bacteria, such as *Salmonella* strains, including wild-type strains, that are one or both of $flagellin^-$ and $pagP^-$ exhibit properties that increase tumor/tumor microenvironment colonization and increase anti-tumor activity. Such strains can be used to deliver a therapeutic payload, such as an immunotherapeutic product and/or other anti-tumor product, and also can include modifications that improve therapeutic properties, such as deletion of hilA, and/or msbB, adenosine auxotrophy, and other properties as describe elsewhere herein. The resulting strains are more effectively targeted to the tumor/tumor microenvironment, by virtue of the modifications that alter infectivity, toxicity to certain cells, and nutritional requirements, such as auxotrophy for purines, that are provided in the tumor environment.

Example 12

FLG and PagP Deletion Mutants are More Attenuated than YS1646 in Mice

To determine whether the modified strains described above are more attenuated than YS1646, a median lethal dose ($LD_{50}$) study was conducted. C57BL/6 mice were injected intravenously with increasing concentrations of YS1646, FLG/ASD (pATI-TREX1), HilA/ASD (pATI-TREX1), or PagP/ASD (pATI-TREX1). The $LD_{50}$ for YS1646 was found to be $1.6\times10^6$ cfu, which is consistent with published reports of this strain. The $LD_{50}$ for the HilA/ASD (pATI-TREX1) strain was determined to be $5.3\times10^6$ cfu, demonstrating a 3-fold reduction in virulence. The $LD_{50}$ for the PagP/ASD (pATI-TREX1) strain was determined to be $6.9\times10^6$ cfu, demonstrating a 4-fold reduction in virulence. The $LD_{50}$ for the FLG/ASD (pATI-TREX1) strain was determined to be $>7\times10^6$ cfu, demonstrating a >4.4-fold reduction in virulence compared to YS1646. These data indicate that the genetic modifications described above reduce the virulence of the *S. typhimurium* therapy and will lead to increased tolerability in humans. In the Phase I clinical trial of VNP20009 (Toso et al. (2002) *J. Clin. Oncol.* 20(1):142-152), the presence of the bacteria in patients' tumors was only partially observed at the two highest doses tested, 3E8 CFU/$m^2$ (33% presence), and 1E9 CFU/$m^2$ (50% presence), indicating that the tolerable dose of VNP20009 was too low to achieve colonization. By improving the tolerability of the strains through the modifications described above, higher doses can be administered than VNP20009. This improves the percentage of patients that will have their tumors colonized, and the level of therapeutic colonization per tumor.

Example 13

*S. typhimurium* Immune Modulator Strains Demonstrate Expression of Heterologous Proteins in Human Monocytes As described above, the hilA gene and flagellin genes fljB and fliC were deleted from the YS1646 strain of *S. typhimurium* with the asd gene deleted, generating strains HilA/ASD and FLG/ASD strains, respectively. In addition, the FLG/ASD strain was further modified to express the listeriolysin O (LLO) protein lacking the signal sequence that accumulates in the cytoplasm of the *Salmonella* strain (FLG/ASD/cLLO). These strains were electroporated with a plasmid containing an expression cassette for the EF-1α promoter and the murine cytokine IL-2. In addition, the FLG/ASD strain was electroporated with an expression plasmid for IL-15δ as a control for a non-cognate cytokine. Additional constructs were created using the CMV promoter.

To determine whether these strains containing expression plasmids could infect human monocytes and induce their production of murine IL-2, THP-1 human monocytic cells were plated at 50,000 cells/well in RPMI (Corning Inc., Corning, NY)+10% Corning® Nu-Serum™ growth medium supplement (Corning Inc.) one day prior to infection. The cells were infected at an MOI of 50 for one hour in RPMI, then washed 3 times with PBS, and resuspended in RPMI+ 100 μg/ml gentamicin (Sigma-Aldrich, St. Louis, MO). Supernatants were collected 48 hrs later from a 96-well plate and assessed for the concentration of murine IL-2 by ELISA (R&D Systems, Minneapolis, MN). The concentration of IL-2 detected in the FLG/ASD-IL158 control wells was found to be very low as expected, and likely reflective of some cross-reactivity to endogenous human IL-2 (6.52 pg/mL). In contrast, the FLG/ASD-IL-2 strain induced an average of 35.1 pg/ml, and even higher in the FLG/ASD/cLLO strain, 59.8 pg/mL. The highest levels were detected in the HilA/ASD-IL-2 strain, 103.4 pg/mL. These data demonstrate the feasibility of expressing and secreting functional heterologous proteins, such as IL-2, from the *S. typhimurium* immune modulator platform strains.

Example 14

Cell Infection with ΔhilA Mutant Leads to Less Human Epithelial Cell Infection

To demonstrate that hilA deleted *S. typhimurium* strains are reduced in their ability to infect epithelial cells, HeLa cervical carcinoma cells were infected with the following *S. typhimurium* strains: YS1646, and YS1646Δasd and YS1646Δasd/ΔhilA, containing plasmids encoding a functional asd gene for plasmid maintenance. $1\times10^6$ HeLa cells were placed in a 24-well dish with DMEM and 10% FBS. Cells were infected with log-phase cultures of *S. typhimurium* for 1 hour, then the cells were washed with PBS and the media was replaced with media containing 50 μg/mL gentamicin to kill extracellular bacteria. After 4 hours, the HeLa cell monolayers were washed with PBS and lysed with 1% Triton X 100 lysis buffer to release intracellular bacteria. The lysates were serially diluted and plated on LB agar plates to quantify the number of intracellular bacteria. The strain with the hilA deletion had a 90% reduction in recovered CFUs compared to the strains with a functional hilA gene, demonstrating that deletion of hilA significantly decreases *S. typhimurium* infection of epithelial-derived cells.

Example 15

Cell Infection with ΔhilA or ΔfljB/ΔfliC Mutants Leads to Less Pyroptosis in Human Macrophages To demonstrate that ΔhilA or ΔfljB/ΔfliC *S. typhimurium* strains are reduced in their ability cause cell death in macrophages, THP-1 human macrophage cells were infected with the following *S. typhimurium* strains: YS1646, and YS1646Δasd, YS1646Δasd/ΔfljB/ΔfliC, and YS1646Δasd/ΔhilA, containing plasmids encoding a functional asd gene to ensure plasmid maintenance. $5\times10^4$ cells were placed in a 96-well dish with DMEM and 10% FBS. Cells were infected with washed log-phase cultures of *S. typhimurium* for 1 hour at a MOI of 100 CFU per cell, then the cells were washed with PBS, and the media was replaced with media containing 50 μg/mL gentamicin to kill extracellular bacteria, and 50 ng/mL of interferon gamma. After 24 hours the THP-1 cells were stained with CellTiter-Glo® reagent (Promega), and the percentage of viable cells was determined using a luminescent cell viability assay using a SpectraMax® plate reader to quantify the luminescence. The cells infected with the hilA deletion strain had approximately 72% viable cells, whereas the YS1646 infected cells had only 38% viability, demonstrating that deletion of hilA prevents cell death of human macrophages. Cells infected with the plasmid-containing strains YS1646Δasd, YS1646Δasd/ΔfljB/ΔfliC had 40% and 51% viability, respectively, indicating that the deletion of the flagellin genes also prevented cell death of human macrophages.

Example 16

Infection of Human Macrophages with an Immunostimulatory *S. typhimurium* Strain Containing a Plasmid Encoding an IL-2 Expression Cassette Leads to Secretion of IL-2

Human THP-1 macrophages were infected with the following *S. typhimurium* strains: YS1646Δasd/ΔfljB/ΔfliC, YS1646Δasd-cytoLLO, and YS1646Δasd/ΔhilA, containing plasmids encoding an expression cassette for mouse IL-2 under a eukaryotic promoter, and a functional asd gene to ensure plasmid maintenance. $5\times10^4$ cells were placed in a 96-well dish with DMEM and 10% FBS. Cells were infected with washed log-phase cultures of *S. typhimurium* for 1 hour at an MOI of 50 CFU per cell, then the cells were washed with PBS and the media was replaced with media containing 50 μg/mL gentamicin to kill extracellular bacteria. After 48 hours, the cellular supernatants were removed and tested for mouse IL-2 using an R&D Systems™ Mouse IL-2 Quantikine® ELISA Kit. The remaining cells were stained with CellTiter-Glo® reagent (Promega), and the percentage of viable cells was determined using a luminescent cell viability assay using a SpectraMax® plate reader to quantify the luminescence. The YS1646Δasd/ΔfljB/ΔfliC, YS1646Δasd-cytoLLO, and YS1646Δasd/ΔhilA strains, containing plasmids encoding an expression cassette for mouse IL-2, expressed 35 pg/mL, 60 pg/mL, and 103 pg/mL of IL-2, respectively.

Example 17

*S. typhimurium* Strains Expressing Murine IL-2 Demonstrate Potent Tumor Growth Inhibition In Vivo The immunostimulatory *S. typhimurium* strains containing deletions in hilA or the flagellin genes fljB and fliC in the YS1646 strain of *S. typhimurium* were combined with the asd gene deletion to form the strains Δasd/ΔhilA and Δasd/ΔfljB/ΔfliC, respectively. These strains were electroporated with a plasmid containing an expression cassette for the EF1α promoter and the murine cytokine IL-2.

To show that the *S. typhimurium* strains containing the IL-2 expression plasmids induce anti-tumor efficacy, the Δasd/ΔhilA strains containing the muIL-2 plasmid or the Δasd/ΔfljB/ΔfliC strains containing the mulL-2 plasmid were compared to vehicle control. 6-8 week-old female C57BL/6 mice (5 mice per group) were inoculated SC in the right flank with MC38 cells ($5\times10^5$ cells in 100 μL PBS). Mice bearing established flank tumors were IV injected on day 8 with $5\times10^5$ CFUs of Δasd/ΔhilA (pATI-muIL-2), Δasd/ΔfljB/ΔfliC (pATI-muIL-2), or PBS vehicle control. Body weights and tumors were measured twice weekly. Tumor measurements were performed using electronic calipers (Fowler, Newton, MA). Tumor volume was calculated using the modified ellipsoid formula, ½(length×width$^2$). Mice were euthanized when tumor size reached >20% of body weight or became necrotic, as per IACUC regulations.

The experiment demonstrated that the Δasd/ΔhilA (pATI-muIL-2) strain elicited significant tumor control compared to PBS (P=0.003, D21). These data were comparable to that observed with the Δasd/ΔfljB/ΔfliC (pATI-muIL-2) strain, which also demonstrated significant tumor growth inhibition compared to PBS (P=0.005, D21). Thus, both strains demonstrate the ability of expressed IL-2 to potently inhibit tumor growth inhibition in a model of colorectal carcinoma.

Example 18

*Salmonella* csgD Gene Knockout Strain Engineering and Characterization ΔansB Strain Construction The ansB gene, which encodes L-asparaginase II, was deleted from the YS1646Δasd/ΔFLG/ΔpagP strain using modifications of the methods described in the preceding examples. Synthetic ansB gene homology arm sequences that contained 236 and 251 bases of the left hand and right hand sequence, respectively, flanking the ansB gene, were synthesized and cloned into a plasmid called pSL0230 (SEQ ID NO:377). A kanamycin gene cassette flanked by cre/loxP sites then was cloned into pSL0230 and the ansB gene knockout cassette was PCR amplified with primers ansb-1 (SEQ ID NO:372) and ansb-2 (SEQ ID NO:373), gel purified and introduced into strain YS1646Δasd carrying the temperature sensitive lambda red recombination plasmid pKD46 by electroporation. The kanamycin resistance gene then was cured by cre-mediated recombination as described above, and the temperature-sensitive plasmids were cured by growth at non-permissive temperature. The ansB gene knockout sequences were amplified by PCR using primers ansb-3 (SEQ ID NO:374) and ansb-4 (SEQ ID NO:375) (see, Table 1), and verified by DNA sequencing. The resulting mutant derivative of YS1646 was designated YS1646Δasd/ΔFLG/ΔpagP/ΔansB.

Strain YS1646Δasd/ΔFLG/ΔpagP/ΔansB was further modified to delete csgD, a master gene that controls *S. typhimurium* curli fimbriae formation, cellulose production, and c-di-GMP production. The csgD deletion eliminates the possibility of cellulose-mediated biofilm formation, reduces pro-inflammatory signaling, and enhances uptake by host phagocytic cells. This increase in intracellular localization would thereby enhance the effectiveness of plasmid delivery and immunomodulatory protein production.

ΔcsgD Strain Construction

The csgD gene was deleted from the YS1646Δasd/ΔFLG/ΔpagP/ΔansB strain, using modifications of the methods described in the preceding examples. Synthetic csgD gene homology arm sequences that contained 207 and 209 bases of the left hand and right hand sequence, respectively, flanking the csgD gene, were synthesized and cloned into a plasmid called pSL0196 (SEQ ID NO:316). A kanamycin gene cassette flanked by cre/loxP sites then was cloned into pSL0196 and the csgD gene knockout cassette was PCR amplified with primers csgd-1 (SEQ ID NO:317) and csgd-2 (SEQ ID NO:318), gel purified and introduced into strain YS1646Δasd carrying the temperature sensitive lambda red recombination plasmid pKD46 by electroporation. The kanamycin resistance gene then was cured by cre-mediated recombination as described above, and the temperature-sensitive plasmids were cured by growth at non-permissive temperature. The csgD gene knockout sequences were amplified by PCR using primers csgd-3 (SEQ ID NO:319) and csgd-4 (SEQ ID NO:320), and verified by DNA sequencing. The resulting mutant derivative of parental strain YS1646 was designated YS1646Δasd/ΔFLG/ΔpagP/ΔansB/ΔcsgD.

Primer Sequence Information

| Primer name | Primer sequence | SEQ. ID NO. |
|---|---|---|
| csgd-1 | cacttgctttaagatttgtaatggctag | 317 |
| csgd-2 | ggtgtattcgctttcccatttgtc | 318 |
| csgd-3 | tgtgctgtccaggttaatgcc | 319 |
| csgd-4 | gacgacggttttctcgaagtctc | 320 |

csgD Deleted Strains Cannot Form RDAR Colonies on Congo Red Plates

The ability to form Rough Dry And Red (RDAR) colonies after growth on Congo Red plates is a well-validated assay for bacterial biofilm formation. The Rough and Dry texture occurs through cellulose production, and the red is due to the accumulation of pigment by the curli fimbriae surface structures. For this assay, the YS1646Δasd/ΔFLG/ΔpagP/ΔansB strain was compared to the YS1646Δasd/ΔFLG/ΔpagP/ΔansB/ΔcsgD strain for the ability to form the RDAR phenotype after incubation on Congo Red agar plates. Congo Red agar plates were prepared with soytone (10 g/L) and yeast extract (5 g/L) (modified LB without NaCl) and complemented with Congo red (40 mg/L) and Coomassie brilliant blue G-250 (20 mg/L). Five microliters of a stationary phase bacterial culture was spotted onto Congo Red plates and incubated at 37° C. for 16 hours, then transferred to 30° C. and incubated for an additional 120 hours. Visual analysis of colony morphology and color was performed and recorded daily to confirm presence or absence of the RDAR colony morphotype.

Comparing the colony morphotypes between the two strains, the YS1646Δasd/ΔFLG/ΔpagP/ΔansB/ΔcsgD strain had a smooth phenotype, and the colonies lacked pigment. In comparison, the YS1646Δasd/ΔFLG/ΔpagP/ΔansB strain, still containing the csgD gene, exhibited the classic rough and dry appearance, and clear evidence of pigment uptake. Thus, the functional assay confirms that the ΔcsgD strain is unable to form biofilms, as it lacks curli fimbriae and cellulose production.

csgD-Deleted Strains Demonstrate Superior Anti-Tumor Efficacy in a Highly Refractory Mouse Model of Triple Negative Breast Cancer The impact of the csgD deletion in models where the immunostimulatory bacterial therapy colonizes tumors, but has shown limited efficacy, was assessed. This can indicate the presence of bacterially-produced cellulose that can limit uptake into tumor-resident myeloid cells, thereby limiting therapeutic benefit (Crull et al. (2011) *Cellular Microbiology* 13(8):1223-1233). The difficult-to-treat EMT6 model was utilized, which is a representative model of human triple negative breast cancer (Yu et al. (2018) *PLoS ONE* 13(11): e0206223). When EMT6 tumor cells are administered orthotopically into the mammary fat pad, as opposed to subcutaneously in the flank, the model is T-cell excluded, highly metastatic, and highly refractory to immunotherapy, including to all approved checkpoint antibodies (Mariathasan et al. (2018) *Nature* 554: 544-548).

For this experiment, 6-8 week-old female BALB/c mice (5 mice per group) were inoculated in the left mammary fat pad with EMT6 tumor cells ($2\times10^5$ cells in 100 μL PBS). Mice bearing 13 day-old established mammary tumors (~55 $mm^3$) were IV injected with a single dose of $1\times10^7$ CFUs of the csgD-deleted strain YS1646Δasd/ΔFLG/ΔpagP/ΔansB/ΔcsgD, or the parental YS1646Δasd/ΔFLG/ΔpagP/ΔansB strain, and compared to PBS control. The bacterial strains contained a plasmid expressing a constitutively active murine STING (EF1a muSTING R283G, see Examples below for details).

The tumors in the PBS-treated mice grew evenly, reaching a max tumor volume at day 35 (1199.0±298.1 $mm^3$). Mice treated with the csgD-intact strain, YS1646Δasd/ΔFLG/ΔpagP/ΔansB, did not demonstrate evidence of anti-tumor efficacy in this model, also reaching max tumor volume at day 35 (1689.1±537.0). Ex vivo LB plating of these tumors revealed all tumors to be colonized. However, the csgD-deleted strain, YS1646Δasd/ΔFLG/ΔpagP/ΔansB/ΔcsgD, resulted in 3 out of 5 mice being completely cured of both their primary and any metastatic disease (day 60+). Overall TGI was 45.7%, with one of the other two tumors partially responding before eventually growing out. The two bacterial strains contained the same plasmid payload, yet only one demonstrated significant efficacy. Thus, in one of the most intractable and highly metastatic syngeneic tumor models, orthotopic EMT6, a strain with a csgD deletion was able to induce systemic anti-tumor efficacy and result in 60% complete responses.

csgD-Deleted Strains Demonstrate Enhanced Intracellular Uptake In Vivo

In order to determine whether the csgD-deleted strain demonstrated improved efficacy because of greater bacterial uptake into tumor-resident myeloid cells, an ex vivo gentamicin protection assay was performed (see, Crull et al. (2011) *Cellular Microbiology* 13(8):1223-1233). For this experiment, 6-8 week-old female C57BL/6 mice (4 mice per group) were inoculated SC in the right flank with MC38 cells ($5\times10^5$ cells in 100 μL PBS). Mice bearing large established flank tumors were IV injected on day 17 with $1\times10^7$ CFUs of the csgD-deleted YS1646Δasd/ΔFLG/ΔpagP/ΔansB/ΔcsgD strain (N=12), or the parental YS1646 strain (N=4). Tumors were resected 7 days post IV dosing, weighed and minced in RPMI supplemented with 1 mg/mL collagenase IV and 20 mg/mL DNase I, and incubated with shaking at 37° C. for 30 minutes to generate a single cell suspension. After 30 minutes, the suspension was passed through a 70 mm filter and the recovered volume was divided into two separate, identical samples. Gentamicin (Thermo Fisher Scientific) was added at 200 mg/mL to one of each of the paired samples to kill extracellular bacteria, and the samples were incubated with shaking at 37° C. for 90 minutes. Cell suspension samples were then washed and lysed with 0.05% Triton X and plated for CFUs.

The results demonstrate that, compared to the CFUs from YS1646-treated tumors without gentamicin treatment (11925±19859 CFUs), gentamicin treatment resulted in very few CFUs detected from the tumors (51±45 CFUs). This indicates that the bacteria reside largely extracellularly in these tumors, and are thus sensitive to gentamicin elimination. In the csgD-deleted YS1646Δasd/ΔFLG/ΔpagP/ΔansB/ΔcsgD treatment group, the non-gentamicin treated tumors yielded high CFUs, as expected from well-colonized tumors, and treatment with gentamicin yielded less CFUs (1276±2410 CFUs), and much more than in the parental YS1646 strain-treated tumors. This is due to more of the csgD-deleted bacteria residing intracellularly, and thus being protected from gentamicin. These data demonstrate that the csgD deletion improves intracellular uptake of the bacteria, which can enhance plasmid delivery of immunomodulatory proteins in vivo.

Example 19

Plasmid Construction

A plasmid, designated pATI-1.75, was designed and synthesized; it contains the following features: a pBR322 origin of replication, the asd gene, a kanamycin resistance gene flanked by HindIII sites for curing, and a multicloning site for expression cassette insertion. The vector was designated pATI-1.75. The expression cassette is composed of multiple elements, including eukaryotic promoters, open reading frames, posttranscriptional regulatory elements and polyadenylation signals, that are assembled in various configurations.

Exemplary promoters include the human cytomegalovirus (CMV) immediate early core promoter encoded directly downstream of the CMV immediate early enhancer sequence and core promoter for human elongation factor-1 alpha (EF-1α). Open reading frames (ORFs) can include one or more sequences that each are translated into a protein, and can be separated into distinct polypeptides by insertion of a 2A sequence, whereby eukaryotic ribosomes fail to insert a peptide bond between Gly and Pro residues within the 2A sequence. Examples of 2A sequences are the T2A peptide from the Thosea asigna virus (TaV) capsid protein, and the P2A peptide from porcine teschovirus (PTV). Upstream furin cleavage sites (RRKR) and other enhancer elements, are placed upstream to facilitate cleavage of expressed proteins.

Examples of post-transcriptional regulatory elements (PREs) include the Woodchuck Hepatitis virus PRE (WPRE) and the Hepatitis B virus PRE (HPRE), which increase accumulation of cytoplasmic mRNA of a gene by promoting mRNA nuclear export to the cytoplasm, enhancing 3' end processing and stability. Examples of polyadenylation signal sequences include the SV40 polyadenylation signal and the bovine growth hormone polyadenylation signal, both of which are 3' regulatory elements that serve to promote transcriptional termination and contain the sequence motif recognized by the RNA cleavage complex.

Example 20

Identification of Gain-of-Function Mutations in Genes that Promote Interferonopathies Cases of subjects presenting with severe auto-inflammatory conditions and vasculopathies of unknown etiology occur, and, often derive from mutations. The cause for these conditions can be identified. Steps to identify a mutational basis for such a pathology are as follows. In step one, intact genomic DNA is obtained from patients experiencing symptoms, and from healthy individuals. Whole exome sequencing is performed, then introns and exons are analyzed. Analysis of genes and identification of mutations in products in the pathways associated with the expression of type I interferon (IFN) is performed. The Table below (and in the detailed description) lists mutations in genes known to lead to constitutive functional activation of the encoded proteins, and subsequent persistent expression of type I IFN. After identification of mutations, cDNA encoding the full-length gene, with and without the identified mutation(s), are transfected into a reporter cell line that measures expression of type I IFN. For example, a reporter cell line can be generated where the expression of luciferase is placed under control of the promoter for IFN-β. A gain-of-function mutant that is constitutively active will promote the expression of IFN-β, whereas the unstimulated wild-type (WT) protein will not. In the case of known STING SAVI (STING-associated vasculopathy with onset in infancy) mutants, the WT-STING stimulation of IFN-β requires the addition of increasing exogenous levels of cGAMP to directly activate WT-STING. Constitutively active mutations stimulate the expression of IFN-β in a cGAMP-independent manner. Exemplary gain-of-function mutations in each of STING, RIG-I, MDA5, IRF3 and IRF7 are set forth below. Other such genes, in which gain-of-function mutations can be identified in subjects or produced by in vitro mutation and screening, include, but are not limited to STING, RIG-I, MDA-5, IRF-3, IRF-5, IRF-7, TRIM56, RIP1, Sec5, TRAF3, TRAF2, TRAF6, STAT1, LGP2, DDX3, DHX9, DDX1, DDX9, DDX21, DHX15, DHX33, DHX36, DDX60, and SNRNP200.

Gain-of-function mutations resulting in the persistent expression of Type I IFN

| STING | RIG-I | MDA5 | IRF3 | IRF7 |
|---|---|---|---|---|
| V147L | E373A | T331I | S396D | S477D/S479D |
| N154S | C268F | T331R | S396D/S398D | S475D/S476D/S477D/S479D/S483D/S487D |
| V155M | | A489T | S396D/S398D/<br>S402D/T404D/<br>S405D | Δ247-467 |
| G166E | | R822Q | | S475D/S477D/S479D |
| C206Y | | G821S | | |
| G207E | | A452T | | |
| R281Q | | A946T | | |
| R284G | | R337G | | |
| R284S | | D393V | | |
| R284M | | G495R | | |
| R284K | | R720Q | | |
| R284T | | R779H | | |
| S102P,<br>F279L | | R779C | | |
| R197A,<br>D205A | | L372F | | |
| S272A,<br>Q273A | | | | |
| R310A,<br>E316A | | | | |
| E316A | | | | |
| E316N | | | | |
| E316Q | | | | |
| S272A | | | | |
| R375A | | | | |
| R293A,<br>T294A,<br>E296A,<br>D231A | | | | |
| R232A | | | | |
| K236A | | | | |
| Q273A | | | | |
| S358A,<br>E360A, | | | | |

-continued

| Gain-of-function mutations resulting in the persistent expression of Type I IFN | | | | |
|---|---|---|---|---|
| STING | RIG-I | MDA5 | IRF3 | IRF7 |
| S366A | | | | |
| D231A. | | | | |
| R232A, | | | | |
| K236A, | | | | |
| R238A | | | | |
| R238A | | | | |
| V147M | | | | |
| S324A, | | | | |
| S326A | | | | |

Amino acid residues R197, D205, R310, R293, T294, E296, S272, Q273, E316, D231, R232, K236, S358, E360, S366, and R238, with reference to the sequence of human STING, as set forth in SEQ ID NOs:305-309, correspond to amino acid residues R196, D204, R309, R292, T293, E295, S271, Q272, E315, D230, R231, K235, S357, E359, S365 and R237, respectively, with reference to the sequence of murine STING, as set forth in SEQ ID NO:351.

Also included are conservative substitutions of each of the replacements (see, Table in the definitions section listing exemplary conservative mutations for each amino acid, i.e., Ser for Ala, where the wild-type is not Ser).

After identification of mutations, cDNA encoding the full-length gene, with and without the identified mutation(s), are transfected into a reporter cell line that measures expression of type I IFN. For example, a reporter cell line can be generated where the expression of luciferase is placed under control of the promoter for IFN-β. A gain-of-function (GOF) mutant that is constitutively active will promote the expression of IFN-β, whereas the unstimulated wild-type (WT) protein will not. In the case of known STING SAVI (STING-associated vasculopathy with onset in infancy) mutants, the WT-STING stimulation of IFN-β requires the addition of increasing exogenous levels of cGAMP to directly activate WT-STING. Constitutively active mutations stimulate the expression of IFN-β in a cGAMP-independent manner. Exemplary gain-of-function mutations in each of STING, RIG-I, MDA5, IRF3 and IRF7 are set forth above and discussed elsewhere herein. Other such genes, in which gain-of-function mutations can be identified in subjects or produced by in vitro mutation and screening, include, but are not limited to STING, RIG-I, MDA-5, IRF-3, IRF-5, IRF-7, TRIM56, RIPE Sec5, TRAF3, TRAF2, TRAF6, STAT1, LGP2, DDX3, DHX9, DDX1, DDX9, DDX21, DHX15, DHX33, DHX36, DDX60, and SNRNP200. The gain-of-function mutations increase expression of type I INFs or render expression constitutive.

Expression of Functional Constitutive Type I IFN Mutants in Human Cells

The specific human STING (allele R232) and IRF3 gain-of-function (GOF) mutants were cloned into the pATI-1.75 vector, and the sequences were confirmed by PCR. To determine whether the STING and IRF3 GOF expression plasmids could induce functional type I IFN in human cells, the plasmids were assessed using HEK293T STING Null Reporter cells (InvivoGen), which do not contain endogenous STING. These cells express secreted embryonic alkaline phosphatase (SEAP), placed under the control of the endogenous IFN-stimulated response element (ISRE) promoter, where the coding sequence of ISRE has been replaced by the SEAP ORF using knock-in technology. Type I interferon activity can be assessed by monitoring Type I IFN-stimulated SEAP production in the cell supernatants.

To test the relative production of type I IFN by the GOF mutants, $1\times10^5$ 293 T-Dual™ Null cells were plated one day prior on plates coated with poly-L-lysine, to achieve 80% confluency in a 24-well plate. On the day of transfection, 200 ng of plasmids encoding a panel of STING and IRF3 GOF mutants, including a STING wild-type (WT) and IRF3 WT control, and a negative control (NC) mutation that has been reported in the literature to be non-functional in human cells (V155R, in STING), were diluted in serum-free media and added to FuGENE® transfection reagent (Promega) at the proper reagent:DNA ratios. Cell culture supernatants from each sample were collected after overnight incubation, and 10 μL of the cell culture supernatants was added to 50 μL QUANTI-Blue™ reagent (InvivoGen) (which is used for measuring SEAP). Type I interferon activation was determined by measuring ISRE-induced SEAP activity on a SpectraMax® M3 Spectrophotometer (Molecular Devices) at an absorbance of 650 nm.

As shown in the table below, all GOF mutants were able to induce type I IFN activity in a STING ligand-independent manner in human cells, compared to the wild-type and negative controls, which did not induce type I IFN activity. The highest levels of type I IFN induction were observed with the human STING R284G and IRF3 S396D phosphomimetic variants. These data support the ability of the plasmids encoding GOF mutants to produce functional, constitutive STING and constitutive phosphomimetic IRF3 that can induce type I IFN in a cGAMP-independent manner.

| GOF Mutant | Mean Absorbance (650 nm) | Standard Deviation |
|---|---|---|
| Plasmid control | 0.049 | 0.002 |
| huSTING WT | 0.144 | 0.004 |
| huSTING V147L | 1.399 | 0.015 |
| huSTING N154S | 1.382 | 0.008 |
| huSTING V155M | 1.360 | 0.048 |
| huSTING C206Y | 1.566 | 0.121 |
| huSTING R281Q | 1.546 | 0.132 |
| huSTING R284G | 1.831 | 0.039 |
| huSTING V155R (NC) | 0.181 | 0.014 |
| huIRF3 WT | 0.781 | 0.073 |
| huIRF3 S396D | 1.922 | 0.131 |

Infection of Flagella-Deleted Strains Containing Plasmids Encoding Constitutive Type I IFN Mutants Converts Human M2 Macrophages to Type I IFN-Producing M1 Macrophages It was determined if primary human M2 macrophages, infected with flagella-deleted strains containing plasmids encoding constitutive type I IFN GOF variants, could be converted to producers of type I IFN and downstream chemokines, such as CXCL10 (also known as IP-10).

Frozen human PBMCs, isolated from healthy human donors, were thawed in complete medium (RPMI-1640+1× non-essential amino acids+5% Human AB serum) and washed by centrifugation for 10 minutes at 800 RPM at room temperature. PBMCs were resuspended in PBS+2% FBS, and monocytes were negatively isolated using a CD16 depletion kit (STEMCELL Technologies, Inc.). Isolated untouched monocytes were then washed by centrifugation in PBS+2% FBS and resuspended in complete medium containing 100 ng/ml human M-CSF and 10 ng/ml human IL-4. Isolated monocytes (3e5 per well) were then seeded in a 24-well plate with a final volume of 750 microliters. Two days after the seeding, the cell culture media was entirely aspirated and replaced with fresh complete medium containing 100 ng/ml human M-CSF and 10 ng/mL human IL-4. Two days later (on day 4), 500 μL of complete medium containing the cytokines was added per well and incubated for 48 hours. On day 6, the cell culture media was entirely aspirated and replaced with fresh complete medium without cytokines. Duplicate wells were infected at an MOI of 450, for one hour in RPMI, with the following strains: YS1646Δasd/ΔFLG containing a plasmid encoding wild-type (WT) human (hu) STING; YS1646Δasd/ΔFLG containing a plasmid encoding the huSTING R284G variant; YS1646Δasd/ΔFLG containing a plasmid encoding WT huIRF3; YS1646Δasd/ΔFLG containing a plasmid encoding the huIRF3 S396D variant; or a strain containing a plasmid control. The cells were then washed 3 times with PBS, and resuspended in RPMI+100 μg/mL gentamicin (Sigma-Aldrich). As a control, the STING agonist 3'5' RpRp c-di-AMP (InvivoGen), an analog of the clinical compound ADU-S100, was added to the cells at 10 μg/mL.

After 24 hours, the cells were lysed with 350 μL Buffer RLT with β-ME (Qiagen, Hilden, Germany) and RNA extraction was performed using the Qiagen RNeasy® Mini Kit with the following modification. A genomic DNA elimination step, using an RNase-Free DNase kit (Qiagen), was included to remove genomic DNA from the total RNA. Total RNA concentration was measured using a NanoDrop™ One$^{C}$ UV-Vis Spectrophotometer (Thermo Fisher Scientific). The purity of each sample also was assessed from the $A_{260}/A_{230}$ absorption ratio. RNA was stored at −80° C. without freeze-thawing until reverse-transcription was performed. Synthesis of cDNA was performed from 0.4-1 ug of template RNA using a Bio-Rad® C1000 Touch™ Thermal Cycler and SuperScript™ VILO™ Master Mix (Invitrogen) in a 30 μL reaction, according to the manufacturer's instructions.

qPCR was performed with a Bio-Rad® CFX96 Real-Time System. SYBR® primers for huCXCL10 (qHsaCED0046619), huIRF3 (qHsaCID0013122), huSTING (qHsaCID0010565), and huIFNB1 (qHsaCED0046851) were purchased from Bio-Rad Laboratories, Inc., Hercules, CA. The qPCR reaction (20 μL) was conducted per protocol, using the iTaq Universal SYBR® Green Supermix (Bio-Rad Laboratories, Inc.). The standard thermocycling program on the Bio-Rad® CFX96 Real-Time System consisted of a 95° C. denaturation for 30 sec, followed by 40 cycles of 95° C. for 5 sec and 60° C. for 30 sec. Reactions with template free control were included for each set of primers on each plate. All samples were run in duplicate, and the mean $C_q$ values were calculated. Quantification of the target mRNA was normalized using Gapdh reference mRNA (qMmuCED0027497, manufactured by Bio-Rad Laboratories, Inc.). $\Delta C_q$ was calculated as the difference between the target and reference gene. $\Delta\Delta C_q$ was obtained by normalizing the $\Delta C_q$ values of the treatments to the $\Delta C_q$ values of the non-treatment control. Fold increase was calculated as $2^{\wedge}-\Delta\Delta C_q$. The values are shown in the table below, as the average of the duplicate wells.

As shown in the table below, compared to the infection of the plasmid control, strains of YS1646Δasd/ΔFLG containing plasmids encoding huSTING WT and huSTING R284G induced high levels of STING expression, which were significantly higher compared to the small molecule STING agonist. Similarly, the strains containing plasmids encoding huIRF3 WT and huIRF3-S396D induced high levels of IRF3 expression, which were significantly higher than the plasmid control or the small molecule STING agonist. The bacterial strain containing a plasmid encoding the huSTING R284G variant induced much higher expression of IFNβ and CXCL10 as compared to the strain containing a plasmid encoding huSTING WT. This demonstrates the ability of the strain, containing a plasmid encoding a constitutive STING GOF variant, to convert a human primary, immunosuppressive M2 macrophage into an M1 type I IFN producing cell. While the strains containing plasmids encoding huIRF3 WT and huIRF3-5396D both induced more IFNβ, they induced less CXCL10 than the huSTING-R284G variant.

| | Fold Expression Over Untransfected Control | | | |
|---|---|---|---|---|
| GOF Mutant | STING | IRF3 | IFNβ | CXCL10 |
| Plasmid Control | 22.3 | 0 | ND | ND |
| huSTING WT | 24017.1 | ND | 3.4 | 3934.5 |
| huSTING R284G | 36542.7 | ND | 20 | 23484.5 |
| huIRF3 WT | 22.7 | 478.9 | 17.5 | 10766.2 |
| huIRF3-S396D | 30.8 | 346.4 | 26.3 | 15696.1 |
| 3'5' RpRp c-di-AMP | 244.8 | 1.11 | 1.77 | 594.1 |

ND = No Data

These data demonstrate the expression of constitutive GOF type I IFN variants in human primary M2 macrophages, and converting these cells to M1-like type I IFN producing cells.

Example 21

Protein Engineering Screening to Identify Improved Gain-of-Function Mutations in STING, RIG-I, MDA5, IRF3, IRF7, and Other Interferon Pathway Genes Gain-of-function (GOF) amino acid mutants that are constitutively active and promote interferonopathies are identified from humans as outlined in Example 20. Many GOF mutations occur due to single base pair nucleotide changes that alter the amino acid codon at that particular position in the gene. For example, in STING, the V147L mutation occurs due to a mutation at c.439G→C; N154S occurs due to a mutation at c.461A→G; and V155M occurs due to a mutation at c.463G→A. The purpose of the screening is to identify constitutively active mutants that lead to high levels of type I interferon expression. Designed mutations, at sites known to promote interferonopathies when mutated, allow for a greater number of amino acid substitutions to be tested. In this example, site-directed mutagenesis with designed amino acids is performed in the positions of known mutations (outlined in the table above (Example 20)), to identify mutations with enhanced activity, that lead to high level type I interferon expression.

PCR primers are generated with designed substitutions flanked on the 5' and 3' ends with homologous cDNA sequences from the gene. The QuikChange® Site-Directed Mutagenesis Kit (Agilent), or other comparable commercially available kit, is used to generate a PCR product incorporating the designed mutation. PCR amplified plasmids are treated with DpnI, then electroporated in competent *E. coli* cells. Individual clones are isolated, plasmid minipreps are performed, and the sequence identity of the desired mutation is confirmed. Larger scale plasmid preps are then performed (using a Qiagen® Plasmid Kit) and the DNA is transfected into HEK293T STING Reporter cells (InvivoGen), which do not contain endogenous STING. These cells express Lucia™ luciferase, a secreted luciferase, placed under the control of the endogenous IFN-β promoter; the coding sequence of IFN-β has been replaced by the Lucia™ luciferase ORF using knock-in technology. Constitutively activated mutants then are identified and ranked by measurement of IFN-β promoter induced expression of luciferase activity.

Example 22

Transformation of Plasmids Encoding Constitutively Active Immuno-Stimulatory Proteins into Immunostimulatory Bacterial Strains Selected plasmids, containing expression cassettes encoding immunostimulatory proteins and a functional asd gene, are electroporated into *S. typhimurium* strains lacking the asd gene with a BTX600® electroporator using a 0.2 cm gap cuvette (BTX, San Diego, Calif.) at the following settings: 2.5 kV, 186 ohms, 50 μF. Electroporated cells are added to 1 ml SOC supplemented with 50 μM diaminopimelic acid (DAP), incubated for 1 hour at 37° C., and then spread onto agar plates that do not contain DAP, to select for strains that received plasmids with a functional asd gene. After single colony isolation, cell banks are produced by inoculating a flask of sterile lysogeny broth (LB) with a single well isolated colony of *S. typhimurium*, and incubating at 37° C. with agitation at 250 RPM. After the culture has grown to stationary phase, the bacteria are washed in PBS containing 10% glycerol, and stored in aliquots frozen at less than −60° C.

Example 23

Plasmids Demonstrate Expression of Functional STING Gain-of-Function Mutants in Human Cells The immunostimulatory bacterial strains are electroporated with a plasmid containing the complemented asd gene, and the expression cassette with a eukaryotic promoter controlling expression of the STING gain-of-function (GOF) mutants.

To determine whether the STING GOF expression plasmids can be transfected into human cells and express functional STING protein, HEK293T STING Reporter cells (InvivoGen), which do not contain endogenous STING, are used. These cells express Lucia™ luciferase, a secreted luciferase, placed under the control of the endogenous IFN-β promoter; the coding sequence of IFN-β has been replaced by the Lucia™ luciferase ORF using knock-in technology. Cyclic dinucleotide (CDN) stimulation can be assessed in 293T-Dual™ STING (ISG/KI-IFNb) cells (InvivoGen), by monitoring IFN-stimulated response element (ISRE)-induced secreted embryonic alkaline phosphatase (SEAP) production and/or IFN-β-dependent expression of Lucia™ luciferase. The two reporter proteins, SEAP and Lucia™ luciferase, are measured in the cell culture supernatant by using QUANTI-Blue™ and QUANTI-Luc™, respectively.

For this, $5\times10^5$ HEK293T-Dual cells containing huSTING (human WT STING), huSTING-null (human Null STING), or WT mSTING (mouse STING) are plated one day prior on plates coated with poly-L-lysine, to achieve 80% confluency. On the day of transfection, plasmids encoding a panel of STING variants (outlined in Example 20 or the written description, or designed as in Example 21) are diluted in serum-free media and added to FuGENE® transfection reagent (Promega) at the proper reagent:DNA ratios, and cells are incubated in the presence or absence of cGAMP, to directly activate STING signaling. Cell culture supernatants from each sample are collected after overnight incubation, and 10 μL of the cell culture supernatants are added to 50 μL QUANTI-Luc™ reagent (InvivoGen). Type I interferon activation is determined by measuring secreted luciferase levels on a SpectraMax® M3 spectrophotometer (Molecular Devices). These data support the ability of the transfected plasmids to produce functional, constitutive STING that can induce type I IFN in a cGAMP-independent manner.

Example 24 mSTING Gain-Of-Function (GOF) Encoding Strains Demonstrate Significant Anti-Tumor Activity in Mice The mSTING GOF strains that encode a constitutive mutant of a cytosolic DNA/RNA sensor, leading to constitutive type I IFN expression, enhance the anti-tumor efficacy of the plasmid-containing target strains in vivo. To demonstrate this, the *S. typhimurium* strain containing the expression plasmids for the mSTING GOF mutants tested in Example 23 are compared to the *S. typhimurium* plasmid vector control strain and vehicle control, for tumor efficacy in a murine colon carcinoma model. 6-8 week-old female C57BL/6 mice (9 mice per group) are inoculated SC in the right flank with MC38 cells ($5\times10^5$ cells in 100 μL PBS). Mice bearing established flank tumors are IV injected on day 8 with $5\times10^5$ CFUs of *S. typhimurium* transformed with mSTING GOF-encoding variants, *S. typhimurium* plasmid control, or PBS vehicle control. Body weights and tumors are measured twice weekly. Tumor measurements are performed using electronic calipers (Fowler, Newton, Mass.). Tumor volume is calculated using the modified ellipsoid formula, ½(length×width$^2$). Mice are euthanized when tumor size reaches >20% of body weight or becomes necrotic, as per IACUC regulations.

The experiment demonstrates that the immunostimulatory bacteria, such as *Salmonella*, such as *S. typhimurium*, that encode mSTING gain-of-function products induce potent tumor control compared to the controls that do not express the mSTING gain-of-function, and compared to PBS.

Example 25

Systemically Administered Bacteria Encoding a Constitutively Active STING Variant Inhibits Growth of MC38 Colon Tumors In Vivo To demonstrate that immunostimulatory bacterial strains containing expression plasmids encoding constitutively active STING induce anti-tumor efficacy, strain YS1646-Δasd/ΔFLG (knockout of both flagellin genes fljB and fliC) was electroporated with a plasmid containing an expression cassette for human STING with allele R232 and GOF mutation V155M (STING R232-V155M) behind the human elongation factor-1 alpha (EF-1 alpha) promoter, and was compared to YS1646 alone and a PBS vehicle control. The gene encoding STING R232-V155M was generated using DNA synthesis. 6-8 week-old female C57BL/6 mice (5 mice per group) were inoculated SC in the right flank with MC38 cells ($5\times10^5$ cells in 100 μL PBS). Mice (n=5) bearing established flank tumors were IV injected on day 8 as follows: (1) PBS; (2) $5\times10^5$ CFUs of YS1646; and (3) $5\times10^5$ CFUs of YS1646-Δasd/ΔFLG STING R232-V155M. Tumor measurements were performed using calipers and tumor volume was calculated using the modified ellipsoid formula, ½(length×width$^2$).

The results, depicted in the table below, showed that the YS1646-Δasd/ΔFLG human STING R232-V155M strain elicited significant tumor control (60% TGI) compared to PBS ($p<0.05$), and had an immediate complete response of 20%. Thus, an immunostimulatory bacterial strain that delivers a constitutively active STING variant can potently inhibit tumor growth inhibition, and demonstrate a 20% cure rate in a model of colorectal carcinoma.

| | Mean Tumor Volume (mm$^3$) | Tumor Growth Inhibition % | p-value vs. Control | % Cures |
|---|---|---|---|---|
| PBS | 188.9 | 0% | | 0% |
| YS1646 | 122.2 | 35% | N.S. | 0% |
| YS1646-Δasd/ ΔFLG huSTING R232-V155M | 75.5 | 60% | <0.05 | 20% |

N.S. = not significant

Example 26

Immunostimulatory Bacteria Encoding Constitutively Active STING Variants Stimulate Enhanced Expression from the Interferon Regulatory Factor (IRF) Promoter Interferon regulatory factors (IRFs), such as IRF-3 and IRF-7, are proteins that regulate the transcription of IFNs. To demonstrate the effects of immunostimulatory bacteria encoding constitutively active STING on the activation of IRFs, a dual IRF-Lucia and MIP-2-SEAP (secreted embryonic alkaline phosphatase) murine reporter cell line (RAW-Dual™ cells; InvivoGen), generated from RAW 264.7 murine macrophages, was used. These macrophages express several pattern recognition receptors (PRRs), including Toll-like receptors (TLRs), cGAS and STING. The reporter cells stably express two reporter genes encoding SEAP (secreted embryonic alkaline phosphatase) and Lucia® luciferase. The Lucia® luciferase reporter gene is under control of an ISG54 (interferon stimulated gene 54) minimal promoter, in conjunction with five IFN-stimulated response elements (ISREs). When IRFs, such as IRF-3 and IRF-7 are activated, they bind to ISREs to induce type I IFN responses. Thus, the expression of the Lucia™ luciferase reports activation of IRFs.

RAW-Dual™ (IRF-Lucia/KI-[MIP-2]SEAP) reporter cells (InvivoGen, Cat. Code: rawd-ismip) were seeded into a 96-well tissue culture plate at $2\times10^5$ cells per well in media (DMEM containing glucose, L-glutamine and 10% FBS) without antibiotic and incubated at 37° C. in 5% $CO_2$ overnight. 3 mL of modified LB cultures (tryptone substituted with soytone) containing 50 μg/mL Kanamycin were inoculated with bacterial strains directly from glycerol stocks and incubated overnight with shaking at 37° C. Strains YS1646-Δasd/ΔFLG and YS1646-Δasd/ΔhilA were transformed with plasmids encoding human STING with the R232 allele (huSTING), or STING variants with the GOF mutation V147L (huSTING V147L) or V155M (huSTING V155M), behind the human elongation factor-1 alpha (EF-1 alpha) promoter. The expression cassettes were generated by DNA synthesis.

The following day, overnight cultures were analyzed by OD600 nm, and culture volumes were adjusted to a concentration of $4\times10^8$ CFU/mL by diluting into eukaryotic cell media (DMEM containing glucose, L-glutamine and 10% FBS without antibiotic). Infections with the bacterial strains were performed at an MOI of 200, by addition of 100 μL diluted culture per well and centrifugation for 5 minutes at 1000 rcf, followed by 1 hour incubation at 37° C. Infections were then washed twice with 100 μL/well sterile PBS, and fresh medium containing 50 μg/mL gentamicin was added, to kill extracellular bacteria. The cyclic dinucleotide, 2'3'-c-di-AM(PS)2 (Rp,Rp) (InvivoGen, Cat. Code: tlrl-nacda2r-01, tlrl-nacda2r) was added to uninfected wells as a positive control for interferon regulatory factor (IRF) induction (CDN positive control). 1 μg cyclic dinucleotide was added per well by addition of 10 μL of 100 μg/mL stock. Infections continued for 48 hours at 37° C. Uninfected reporter cells were used as a negative control, as were reporter cells that were infected with strain YS1646-Δasd/ΔFLG encoding mu-IL-2.

IRF pathway induction was analyzed at 48 hours post infection. 20 μL supernatant was harvested per well and mixed with 50 μL freshly prepared QUANTI-Luc™ detection medium (a Lucia® luciferase detection reagent; InvivoGen, Cat. Code: rep-qlc1, rep-qlc2) in a black, flat clear-bottom 96-well plate, and luminescence was detected on a SpectraMax® M5 Microplate Reader (Molecular Devices). The results are shown in the table below. Uninfected cells, and cells infected with YS1646-Δasd/ΔFLG encoding mu-IL-2 (negative controls) showed the lowest amount of IRF luminescence. Uninfected cells with added CDN (CDN positive control) showed the highest amount of IRF luminescence. In the YS1646-Δasd/ΔFLG strain, huSTING with the V147L mutation had a 258% increase in IRF luminescence compared to huSTING, and huSTING with the V155M mutation had a 282% increase compared to huSTING. In the YS1646-Δasd/ΔhilA strain, huSTING with the V147L mutation had a 1086% increase in IRF luminescence compared to huSTING, and huSTING with the V155M mutation had a 201% increase compared to huSTING. Thus, constitutively active STING variants can be delivered to macrophages via infection with immunostimulatory bacteria to activate downstream IRF pathway signaling.

| Raw-Dual ™ Cell IRF Illuminescence at 48 hours post infection | | | | | | | | | |
|---|---|---|---|---|---|---|---|---|---|
| | | | YS1646 Strain + plasmid combination | | | | | | |
| | | | Δasd/ΔFLG | | | | | | |
| | Uninfected | CDN | | | Hu- | Hu- | Δasd/ΔhilA | | |
| Measurement | Cells (no CDN) | Positive Control | mu-IL-2 | Hu-STING | STING V147L | STING V155M | HuSTING | HuSTING V147L | HuSTING V155M |
| 1 | 53 | 1407 | 84 | 146 | 414 | 473 | 81 | 1204 | 190 |
| 2 | 31 | 1401 | 84 | 146 | 364 | 355 | 93 | 1164 | 187 |
| 3 | 37 | 1537 | 90 | 121 | 289 | 339 | 134 | 977 | 243 |
| Average | 40.3 | 1448.3 | 86.0 | 137.7 | 355.7 | 389.0 | 102.7 | 1115.0 | 206.7 |
| Standard Dev. | 11.4 | 76.8 | 3.5 | 14.4 | 62.9 | 73.2 | 27.8 | 121.2 | 31.5 |

Example 27

Immunostimulatory Bacteria Containing Plasmids Encoding Constitutive Type I IFN Variants Demonstrate Potent Anti-tumor Immunity in a Murine Model of Colorectal Cancer

Human GOF STING Mutants Show Anti-Tumor Activity in Mouse Models

To demonstrate that immunostimulatory bacterial strains containing expression plasmids encoding constitutively active STING variants induce anti-tumor efficacy, strain YS1646Δasd/ΔFLG (knockout of both flagellin genes fljB and fliC) was electroporated with a plasmid containing an expression cassette for human STING with the allele R232 and the GOF mutation V155M (huSTING V155M), behind the human elongation factor-1 alpha (EF-1a) promoter, and was compared to strain YS1646 alone and a PBS vehicle control. The gene encoding huSTING V155M was generated using DNA synthesis and cloned into the pATI-1.75 vector. In order to evaluate whether a constitutive human STING variant could demonstrate anti-tumor activity in mice, 6-8 week-old female C57BL/6 mice (5 mice per group) were inoculated SC in the right flank with MC38 colorectal adenocarcinoma cells ($5\times10^5$ cells in 100 μL PBS). Mice bearing established flank tumors were IV injected on day 8 with $5\times10^5$ CFUs of strain YS1646Δasd/ΔFLG huSTING V155M, with strain YS1646, or with PBS control.

The results showed that the YS1646 parental strain was only mildly effective as an anti-tumor therapy and was not curative (35% TGI, p=NS, day 28), in line with previously published data. The more attenuated strain, containing a plasmid encoding constitutively active human STING, YS1646Δasd/ΔFLG huSTING V155M, however, elicited significant tumor control (60% TGI, $p<0.05$, day 28) compared to PBS, and had a cure rate of 20%. Thus, an immunostimulatory bacterial strain that delivers a constitutively active STING variant potently inhibits tumor growth inhibition, and demonstrates curative effects in a model of colorectal adenocarcinoma.

Murine Phosphomimetic IRF3 Shows Curative Effects In Vivo

The murine version of the phosphomimetic human IRF3 variant was designed, designated muIRF3-S388D, and evaluated in a murine model of colorectal adenocarcinoma. Strain YS1646Δasd/ΔFLG was electroporated with a plasmid containing an expression cassette for murine IRF3 with the GOF mutation S388D (muIRF3-S388D), behind the human elongation factor-1 alpha (EF-1α) promoter, and was compared to PBS vehicle control. The gene encoding muIRF3-S388D was generated using DNA synthesis and cloned into the pATI-1.75 vector. 6-8 week-old female C57BL/6 mice (5 mice per group) were inoculated SC in the right flank with MC38 colorectal adenocarcinoma cells ($5\times10^5$ cells in 100 μL PBS). Mice bearing established flank tumors were IV injected on day 10 with $5\times10^5$ CFUs of strain YS1646Δasd/ΔFLG-EF-1α-muIRF3-S388D, and compared to PBS vehicle control.

The therapy was very well tolerated, with an initial weight loss nadir of only 0.3%. Compared to PBS, the bacterial strain containing the plasmid encoding the muIRF3-S388D GOF mutant was highly effective and curative (81.8% TGI, 60% cure rate, day 42). These data demonstrate the potency and safety of delivering constitutive type I IFN inducing variants in a tumor-specific manner.

Murine STING GOF Variants Show Potent and Curative Anti-Tumor Activity

A panel of murine orthologs of the human STING variants, discovered in human patients, was designed. These orthologs differ by one codon from the human variants, and were cloned into the pATI-1.75 vector under the control of an EF-1α promoter, to yield the following set of mutants: muSTING N153S, V154M, R280Q, V146L, R283G, and C205Y, among others. The STING variants were evaluated in the MC38 model of murine adenocarcinoma for anti-tumor efficacy. For the studies, 6-8 week-old female C57BL/6 mice (5 mice per group) were inoculated SC in the right flank with MC38 colorectal adenocarcinoma cells ($5\times10^5$ cells in 100 μL PBS). Mice bearing established flank tumors were IV injected on day 10 with $5\times10^5$ CFUs of strain YS1646Δasd/ΔFLG, containing a plasmid with EF-1α driving the expression of muSTINGN153S, V154M, R280Q, V146L, or R283G, or a scrambled shRNA plasmid control, and compared to PBS vehicle control.

In this experiment, the YS1646Δasd/ΔFLG EF-1α plasmid control (shSCR) demonstrated anti-tumor efficacy as compared to PBS control (73% TGI, day 26), which was much more potent than the YS1646 parental strain has shown historically. This can be due to inherently immunostimulatory elements on the plasmid, such as CpGs and RNAi stimulatory elements. This therapy was the least well tolerated of the group, demonstrating a weight loss nadir of 9.9% that only resolved at the very end of the study. In contrast, the constitutive murine STING mutants resulted in a lower weight loss that was transient and that resolved within days. The relative anti-tumor efficacy of these variants revealed interesting differences in activity, with only two variants demonstrating curative effects and enhanced efficacy over the plasmid control, N153S and R283G.

| GOF Mutant | TGI vs. PBS, Day 26 | Complete Response | Weight Loss Nadir and Day |
|---|---|---|---|
| Plasmid Control | 73.0% | 0/5 | 9.9%, day 19 |
| muSTING N153S | 81.7% | 1/5 | 6.2%, day 12 |
| muSTING V154M | 69.4% | 0/5 | 4.3%, day 12 |
| muSTING R280Q | 68.7% | 0/5 | 5.4%, day 12 |
| muSTING V146L | 63.4% | 0/5 | 2.8%, day 12 |
| muSTING R283G | 81.2% | 1/5 | 6.9%, day 12 |

In a follow-up study, the murine STING C205Y variant was tested along with the R283G and N153S variants to compare their anti-tumor efficacy. 6-8 week-old female C57BL/6 mice (5 mice per group) were inoculated SC in the right flank with MC38 colorectal adenocarcinoma cells ($5\times10^5$ cells in 100 μL PBS). Mice bearing established flank tumors were IV injected on day 9 with $5\times10^5$ CFUs of strain YS1646Δasd/ΔFLG containing a plasmid with EF-1α driving expression of muSTING N153S, R283G, or C205Y, and compared to PBS vehicle control. As before, the STING variants were well tolerated, and only a transient dip in weight loss was observed that resolved quickly. This is likely due to on-target therapy, as it is also observed with the small molecule STING agonists. The efficacy of the two constitutively active murine STING variants, N153S and R283G, was nearly identical to the previous study, although the weight loss was much less, for reasons unclear. The C205Y variant also was highly effective, although not curative.

| GOF Mutant | TGI vs. PBS, Day 29 | Complete response (CR) | Weight Loss Nadir and Day |
|---|---|---|---|
| muSTING C205Y | 79.4% | 0/5 | 2.6%, day 13 |
| muSTING N153S | 79.3% | 1/5 | 2.2%, day 13 |
| muSTING R283G | 85.1% | 1/5 | 1.8%, day 13 |

The STING-cured mice from these studies were re-challenged at day 40 post-initial tumor implantation on the opposite flank, SC with MC38 colorectal adenocarcinoma cells ($5\times10^5$ cells in 100 μL PBS). Compared to naïve mice (N=5), in which all tumors grew out, all of the STING-cured mice rejected the tumors, demonstrating the engagement of adaptive immunity.

These data validate the safety and potency of the murine versions of the human constitutive STING variants in a murine model of colorectal carcinoma, and reveal a small subset that have enhanced potency compared to the other STING variants. These highly active variants also elicit protective immunity, demonstrating the potency of tumor-specific production of type I interferon.

Murine STING GOF Variants Demonstrate Significant Tumor Remodeling Following IV Dosing It was next determined whether the bacterial strains containing plasmids encoding constitutive STING variants demonstrate differences in their ability to remodel the tumor microenvironment (TME) following IV dosing. To test this, 6-8 week-old female C57BL/6 mice (5 mice per group) were inoculated SC in the right flank with MC38 colorectal adenocarcinoma cells ($5\times10^5$ cells in 100 μL PBS). Mice bearing established flank tumors were IV injected on day 8 with $5\times10^5$ CFUs of strain YS1646Δasd/ΔFLG containing a plasmid with EF-1α driving the expression of muSTING N153S, V154M, R280Q, V146L, R283G, or plasmid control, and compared to PBS vehicle control.

At day 28 post tumor implantation, tumors were excised for analysis. Tumors were cut into 2-3 mm pieces into gentleMACS™ C tubes (Miltenyi Biotec) filled with 2.5 mL enzyme mix (RPMI-1640+10% FBS with 1 mg/mL Collagenase IV and 20 μg/mL DNase I). The tumor pieces were dissociated using the OctoMACS™ Separator specific dissociation program (mouse implanted tumors) (Miltenyi Biotec) and the whole cell preparation was incubated with agitation for 45 minutes at 37° C. After 45 minutes of incubation, a second round of dissociation was performed using the OctoMACS™ Separator Kit (mouse implanted tumor program), and the resulting single cell suspensions were filtered through a 70 μM nylon mesh into a 50 mL tube. The nylon mesh was washed once with 5 mL of RPMI-1640 10% FBS and the cells were filtered a second time using a new 70 μM nylon mesh into a new 50 mL tube. The nylon mesh was washed with 5 mL of RPMI-1640 with 10% FBS and the filtered cells were then centrifuged at 1000 RPM for 7 minutes. The resulting dissociated cells were resuspended in PBS and kept on ice before the staining process.

The percentage of live tumor-infiltrating leukocytes (TILs), including $CD4^+$ Tregs, $CD4^+$ Th1 cells, $CD8^+$ T cells, neutrophils, monocytes, dendritic cells (DCs), M1 macrophages and M2 macrophages, following the administration of strain YS1646Δasd/ΔFLG, containing plasmids encoding the various GOF muSTING mutants, was determined by flow cytometry. For the flow-cytometry staining, 100 μL of the single cell suspensions were seeded in wells of a V-bottom 96-well plate. PBS containing a Zombie Aqua™ dead/live stain (BioLegend) and Fc Blocking reagents (BD Biosciences) were added at 100 μL per well and incubated on ice for 30 minutes in the dark. After 30 minutes, cells were washed twice with PBS+2% FBS by centrifugation at 1300 RPM for 3 minutes. Cells were then resuspended in PBS+2% FBS, containing fluorochrome-conjugated antibodies (CD4 FITC clone RM4-5; CD8a BV421 clone 53-6.7; F4/80 APC clone BM8; CD11b PE-Cy7 clone M1/70; CD45 BV570 clone 30-F11; CD3 PE clone 145-2C11; Ly6C BV785 clone HK1.4; I-A/I-E APC-Cy7 clone M5/114.15.2; Ly6G BV605 clone 1A8; and CD24 PercP-Cy5.5 clone M1/69; all from BioLegend) and incubated on ice for 30 minutes in the dark. After 30 minutes, cells were washed twice with PBS+2% FBS by centrifugation at 1300 RPM for 3 minutes and resuspended in flow cytometry fixation buffer (Thermo Fisher Scientific). Flow cytometry data were acquired using the ACEA NovoCyte® flow cytometer (ACEA Biosciences, Inc.) and analyzed using the FlowJo™ software (Tree Star, Inc.).

As shown in the tables below, the strain YS1646Δasd/ΔFLG with the EF-1α plasmid control demonstrated predominantly high neutrophil infiltration, despite some $CD8^+$ T-cell recruitment, likely due to immunostimulatory elements on the plasmid. In contrast, the different muSTING variants had unique tumor-infiltrating immune cell signatures, with some, such as muSTING V146L and muSTING R283G resulting in fewer immunosuppressive neutrophils than the PBS control. The most favorable immune profiles were observed in the tumors from mice that were administered muSTING mutants R283G and N153S, with high numbers of $CD4^+$ Th1 cells and $CD8^+$ T cells, and low numbers of neutrophils, which indicates highly favorable conditions for generating an adaptive immune response. These trends were also recapitulated in the total cell counts, as shown below. Thus, delivery of constitutively active STING variants to the tumor-resident myeloid cells leads to a complete remodeling of the immunosuppressive tumor microenvironment, towards an adaptive anti-tumor phenotype, and away from a bacterial phenotype, which is characterized by the promotion of innate immunity and the suppression of adaptive immunity.

| % of Live Tumor-Infiltrating Leukocytes (TILs) | | | | | | | |
|---|---|---|---|---|---|---|---|
| | GOF muSTING Mutants Encoded on Plasmids in IV Administered Strain YS1646Δasd/ΔFLG | | | | | | |
| % among TILs | PBS | Plasmid Control | muSTING N153S | muSTING V154M | muSTING R280Q | muSTING V146L | muSTING R283G |
| $CD4^+$ Tregs | 2.9 ± 1.7 | 1.8 ± 0.5 | 3.3 ± 2.6 | 1.5 ± 0.5 | 2 ± 0.9 | 1.8 ± 0.5 | 1.5 ± 0.4 |
| $CD4^+$ Th1 cells | 6.6 ± 3.2 | 13 ± 4.3 | 20.7 ± 10.4 | 13.2 ± 6.1 | 22.6 ± 7.4 | 19.5 ± 4.9 | 25.6 ± 7.8 |
| $CD8^+$ T cells | 16.2 ± 10.2 | 24.5 ± 11.6 | 25.8 ± 9.2 | 16.5 ± 4.4 | 20.2 ± 7.2 | 20.8 ± 3.6 | 27.8 ± 8.7 |
| Neutrophils | 11.3 ± 14.2 | 30.6 ± 17.4 | 13.5 ± 12.4 | 21.4 ± 12.5 | 15.9 ± 11.6 | 9.1 ± 6.5 | 6.6 ± 5.9 |
| Monocytes | 16.6 ± 3.5 | 12.7 ± 2.7 | 13.7 ± 3.9 | 16.4 ± 5.4 | 15.8 ± 6.5 | 15.6 ± 2.2 | 13.5 ± 1.3 |
| DCs | 1.4 ± 0.4 | 0.5 ± 0.3 | 0.9 ± 0.7 | 0.4 ± 0.2 | 0.5 ± 0.3 | 0.5 ± 0.2 | 0.5 ± 0.3 |
| M1 Macrophages | 10.2 ± 6.2 | 3.1 ± 2.1 | 4.6 ± 2.1 | 9.4 ± 5 | 5.6 ± 4.2 | 8.6 ± 3.7 | 5.4 ± 2 |
| M2 Macrophages | 14.9 ± 10.6 | 4.6 ± 2.6 | 7.3 ± 3.1 | 11.6 ± 5.2 | 8.6 ± 6.3 | 12.8 ± 5 | 9.2 ± 4 |

| Total Cell Counts | | | | | | | |
|---|---|---|---|---|---|---|---|
| | PBS | Plasmid Control | muSTING N153S | muSTING V154M | muSTING R280Q | muSTING V146L | muSTING R283G |
| $CD4^+$ Tregs | 437 ± 230 | 148 ± 102 | 530 ± 117 | 310 ± 114 | 520 ± 169 | 297 ± 207 | 438 ± 176 |
| $CD4^+$ Th1 cells | 1108 ± 599 | 1059 ± 711 | 3765 ± 917 | 3349 ± 2869 | 5864 ± 1618 | 2961 ± 1800 | 7463 ± 3240 |
| $CD8^+$ T cells | 2948 ± 3119 | 1571 ± 601 | 6152 ± 3820 | 3898 ± 2823 | 5446 ± 2454 | 3266 ± 1277 | 7566 ± 1782 |
| Neutrophils | 1531 ± 1604 | 2604 ± 1975 | 3699 ± 4400 | 4815 ± 3423 | 4301 ± 3502 | 1240 ± 1160 | 1698 ± 1485 |
| Monocytes | 2871 ± 1472 | 912 ± 369 | 3182 ± 1708 | 3350 ± 1183 | 4132 ± 1595 | 2524 ± 1420 | 3811 ± 996 |
| DCs | 233 ± 97 | 28 ± 18 | 161 ± 45 | 82 ± 31 | 130 ± 90 | 78 ± 48 | 135 ± 90 |
| M1 Macrophages | 2163 ± 2025 | 227 ± 213 | 881 ± 316 | 1797 ± 750 | 1421 ± 910 | 1325 ± 856 | 1524 ± 658 |
| M2 Macrophages | 3046 ± 2996 | 334 ± 275 | 1391 ± 373 | 2183 ± 608 | 2189 ± 1402 | 2043 ± 1237 | 2612 ± 1330 |

Example 28

Immunostimulatory Bacteria Modified to Express Vertebrate STING Variants that Induce Stronger Type I IFN Signaling and/or Weaker NF-κB Signaling than Human STING STING signaling activates two signaling pathways. The first is the TANK binding kinase (TBK1)/IRF3 axis, resulting in the induction of type I IFNs, and the activation of dendritic cells (DCs) and cross-presentation of tumor antigens to activate $CD8^+$ T cell-mediated anti-tumor immunity. The second is the nuclear factor kappa-light-chain-enhancer of activated B cell (NF-κB) signaling axis, resulting in a pro-inflammatory response, but not in the activation of the DCs and $CD8^+$ T cells that are required for anti-tumor immunity. Bacterially-based cancer immunotherapies are limited in their ability to induce type I IFN to recruit and activate the $CD8^+$ T cells necessary to promote tumor antigen cross-presentation and durable anti-tumor immunity. Hence, provided are immunostimulatory bacteria herein that induce and/or increase type I IFN signaling, and that have decreased NF-κB signaling, thereby increasing the induction of $CD8^+$ T cell mediated anti-tumor immunity, and enhancing the therapeutic efficacy of the bacteria. The immunostimulatory bacteria described above encode modified STING proteins that are gain-of-function mutants of STING that can increase induction of type I IFN compared to wild type STING, or render the expression of type I IFN constitutive. In this example (and also described in the detailed description), the STING protein is modified to reduce or eliminate NF-κB signaling activity, and retain the ability to induce type I IFN, and/or is modified for increased or constitutive type I IFN expression. This results in immunostimulatory bacteria that induce anti-tumor immunity, and do not induce (or induce less) NF-κB signaling that normally results from infection by bacterial pathogens.

STING proteins from different species exhibit different levels of type I IFN and NF-κB signaling activities. For example, STING signaling in human and mouse cells results in a strong type I IFN response, and a weak pro-inflammatory NF-κB response. STING signaling in ray-finned fish, such as salmon and zebrafish, in comparison, elicits robust activation of a primarily NF-κB-driven response, that is more than 100-fold higher compared with the IRF3-driven (i.e., type I IFN inducing) response. In other species, such as Tasmanian devil, STING signaling results in a type I IFN response, but essentially no NF-κB response. The immunostimulatory bacteria provided herein encode STING from non-human species, such as Tasmanian devil STING, in order to exploit the ability of STING to induce a type I IFN response, but without the concomitant induction of an NF-κB response. As described herein, these non-human STING proteins also are modified by mutation to increase the type I IFN response, or to render it constitutive. The identified mutations that have this effect in human STING are introduced into the non-human STING proteins. The corresponding residues are identified by alignment.

Also provided are chimeras in which the C-terminal tail (CTT) of STING is replaced in one species, such as human, with the CTT from a second (e.g., non-human) species that exhibits little or no NF-κB signaling activity. The CTT is an unstructured stretch of approximately 40 amino acids that contains sequence motifs required for STING phosphorylation and recruitment of IRF3. It can shape downstream immunity by altering the balance between type I IFN and NF-κB signaling. This is controlled through independent modules in the CTT, including IRF3, TBK1 and TRAF6 binding modules. For example, human STING residue S366 (see, e.g., SEQ ID NOs:305-309) is a primary TBK1 phosphorylation site that is part of an LxIS motif in the CTT, which is required for IRF3 binding, while a second PxPLR motif, including residue L374, is required for TBK1 binding. The LxIS and PxPLR motifs are highly conserved in all vertebrate STING alleles. Replacing the CTT of human STING with that of, for example, Tasmanian devil STING, produces a STING that induces a type I IFN response, but not an NF-κB response.

In this Example, the immunostimulatory bacteria are engineered to express a STING variant with increased type I IFN signaling, and/or reduced NF-κB signaling, compared to wild type (WT) human STING (SEQ ID NOs:305-309). The STING variants can be from a non-human vertebrate, such as a mammalian, bird, reptilian, amphibian or fish species. Species from which the non-human STING proteins are derived include, but are not limited to, Tasmanian devil (*Sarcophilus harrisii*; SEQ ID NO:331), marmoset (*Callithrix jacchus*; SEQ ID NO:341), cattle (*Bos taurus*; SEQ ID NO:342), cat (*Felis catus*; SEQ ID NO:338), ostrich (*Struthio camelus australis*; SEQ ID NO:343), crested ibis (*Nipponia nippon*; SEQ ID NO:344), coelacanth (*Latimeria chalumnae*; SEQ ID NOs:345 and 346), boar (*Sus scrofa*; SEQ ID NO:347), bat (*Rousettus aegyptiacus*; SEQ ID NO:348), manatee (*Trichechus manatus latirostris*; SEQ ID NO:349), ghost shark (*Callorhinchus milii*; SEQ ID NO:350), and mouse (*Mus musculus*; SEQ ID NO:351). These vertebrate STING proteins readily activate immune signaling in human cells, indicating that the molecular mechanism of STING signaling is shared among vertebrates (see, e.g., de Oliveira Mann et al. (2019) *Cell Reports* 27:1165-1175). STING proteins from these species induce less NF-κB signal activation and/or more type I IFN signal activation, than human STING (see, e.g., de Oliveira Mann et al. (2019) *Cell Reports* 27:1165-1175, FIG. 1A). Wild-type or modified STING proteins from different non-human species can be expressed by the immunostimulatory bacteria herein, as can chimeras of human and non-human STING proteins.

The various non-human STING proteins are modified, such that the non-human STING has lower NF-κB activation, and, optionally, higher type I interferon activation, than human STING. These non-human STING proteins are modified to include a mutation or mutations so that they have increased type I IFN activity, or act constitutively, in the absence of cytosolic nucleic acid ligands (e.g., CDNs). The mutations typically are amino acid mutations, such as gain-of-function mutations, that are associated with interferonopathies in humans. The corresponding mutations are introduced into the non-human species STING proteins, where corresponding amino acid residues are identified by alignment. For example, mutations include, but are not limited to, S102P, V147L, V147M, N154S, V155M, G166E, C206Y, G207E, S102P/F279L, F279L, R281Q, R284G, R284S, R284M, R284K, R284T, R197A, D205A, R310A, R293A, T294A, E296A, R197A/D205A, S272A/Q273A, R310A/E316A, E316A, E316N, E316Q, S272A, R293A/T294A/E296A, D231A, R232A, K236A, Q273A, S358A/E360A/S366A, D231A/R232A/K236A/R238A, S358A, E360A, S366A, R238A, R375A, and S324A/S326A, with reference to the sequence of human STING, as set forth in SEQ ID NOs:305-309. Corresponding mutations in STING from other species are listed in the tables below. The resulting variants of the non-human STING proteins include one or more of these mutations, and optionally, a CTT replacement, and optionally a deletion in the TRAF6 binding site.

The STING variants include one or more replacements of the amino acid serine (S) or threonine (T) at a phosphorylation site, with aspartic acid (D), which is phosphomimetic, resulting in increased or constitutive activity. Other mutations, include deletion or replacement of a phosphorylation site or sites, such as 324-326 SLS→ALA in STING, and other replacements to eliminate a phosphorylation site to reduce NF-κB signaling in STING. Additionally, chimeras of human STING with STING from other species are provided, in which the C-terminal tail (CTT) of human STING is replaced with the CTT of STING from another species that has lower NF-κB signaling activity, and/or higher type I IFN signaling activity. The variant STING proteins can include a deletion in the TRAF6 binding site of the CTT, to reduce NF-κB signaling.

| Human STING (SEQ ID NOs: 305-309) | Tasmanian devil STING (SEQ ID NO: 331) | Marmoset STING (SEQ ID NO: 341) | Cattle STING (SEQ ID NO: 342) | Cat STING (SEQ ID NO: 338) | Ostrich STING (SEQ ID NO: 343) | Crested ibis STING (SEQ ID NO: 344) | Coelacanth STING (SEQ ID NO: 345) |
|---|---|---|---|---|---|---|---|
| S102P | S102P | S102P | S102P | S102P | C107P | V106P | A102P |
| V147L | V147L | V145L | I147L | V146L | M152L | M151L | I147L |
| V147M | V147M | V145M | I147M | V146M | — | — | I147M |
| N154S | N154S | N152S | N154S | N153S | N159S | N158S | G154S |
| V155M | V155M | V153M | V155M | V154M | V160M | V159M | V155M |
| G166E | G166E | G164E | G166E | G165E | G171E | G170E | G166E |
| C206Y | C206Y | C204Y | C206Y | C205Y | C211Y | C210Y | C206Y |
| G207E | S207E | G205E | G207E | G206E | N212E | D211E | S207E |
| S102P/ F279L | S102P/ F279L | S102P/ F277L | S102P/ F279L | S102P/ F278L | C107P/ F283L | V106P/ F283L | A102P/ F279L |
| F279L | F279L | F277L | F279L | F278L | F283L | F283L | F279L |
| R281Q | R281Q | R279Q | R281Q | R280Q | R285Q | R285Q | K281Q |
| R284G | R284G | R282G | R284G | R283G | R288G | R288G | R284G |
| R284S | R284S | R282S | R284S | R283S | R288S | R288S | R284S |
| R284M | R284M | R282M | R284M | R283M | R288M | R288M | R284M |
| R284K | R284K | R282K | R284K | R283K | R288K | R288K | R284K |

-continued

| | | | | | | | |
|---|---|---|---|---|---|---|---|
| R284T | R284T | R282T | R284T | R283T | R288T | R288T | R284T |
| R197A | R197A | R195A | R197A | R196A | K202A | K201A | R197A |
| D205A | D205A | D203A | D205A | D204A | S210A | S209A | S205A |
| R310A | R310A | R308A | R310A | R309A | R314A | R314A | R310A |
| R293A | R293A | R291A | R293A | R292A | R297A | R297A | R293A |
| T294A | T294A | T292A | T294A | I293A | T298A | T298A | T294A |
| E296A | E296A | E294A | E296A | E295A | E300A | E300A | K296A |
| R197A/ | R197A/ | R195A/ | R197A/ | R196A/ | K202A/ | K201A/ | R197A/ |
| D205A | D205A | D203A | D205A | D204A | S210A | S209A | S205A |
| S272A/ | S272A/ | S270A/ | S272A/ | S271A/ | S276A/ | S276A/ | S272A/ |
| Q273A | Q273A | Q271A | Q273A | Q272A | Q277A | Q277A | K273A |
| R310A/ | R310A/ | R308A/ | R310A/ | R309A/ | R314A/ | R314A/ | R310A/ |
| E316A | E316A | E314A | E316A | E315A | E320A | E320A | E318A |
| E316A | E316A | E314A | E316A | E315A | E320A | E320A | E318A |
| E316N | E316N | E314N | E316N | E315N | E320N | E320N | E318N |
| E316Q | E316Q | E314Q | E316Q | E315Q | E320Q | E320Q | E318Q |
| S272A | S272A | S270A | S272A | S271A | S276A | S276A | S272A |
| R375A | R377A | R373A | R374A | R373A | R371A | R379A | K376A |
| R293A/ | R293A/ | R291A/ | R293A/ | R292A/ | R297A/ | R297A/ | R293A/ |
| T294A/ | T294A/ | T292A/ | T294A/ | I293A/ | T298A/ | T298A/ | T294A/ |
| E296A | E296A | E294A | E296A | E295A | E300A | E300A | K296A |
| D231A | D231A | D229A | D231A | D230A | T236A | T235A | N231A |
| R232A | R232A | R230A | R232A | R231A | R237A | R236A | R232A |
| K236A | K236A | K234A | K236A | K235A | K241A | K240A | K236A |
| Q273A | Q273A | Q271A | Q273A | Q272A | Q277A | Q277A | K273A |
| S358A/ | S360A/ | S356A/ | S357A/ | S356A/ | S354A/ | S362A/ | S359A/ |
| E360A/ | E362A/ | E358A/ | E359A/ | E358A/ | D356A/ | E364A/ | E361A/ |
| S366A | S368A | S364A | S365A | S364A | S362A | S370A | S367A |
| D231A/ | D231A/ | D229A | D231A/ | D230A/ | T236A/ | T235A/ | N231A/ |
| R232A/ | R232A/ | R230A/ | R232A/ | R231A/ | R237A/ | R236A/ | R232A/ |
| K236A/ | K236A/ | K234A | K236A/ | K235A/ | K241A/ | K240A/ | K236A/ |
| R238A | R238A | R236A | R238A | R237A | R243A | R242A | R238A |
| S358A | S360A | S356A | S357A | S356A | S354A | S362A | S359A |
| E360A | E362A | E358A | E359A | E358A | D356A | E364A | E361A |
| S366A | S368A | S364A | S365A | S364A | S362A | S370A | S367A |
| R238A | R238A | R236A | R238A | R237A | R243A | R242A | R238A |
| S324A/ | S326A/ | L322A/ | S324A/ | S323A/ | F328A/ | S328A/ | S327A |
| S326A | S328A | S324A | S326A | S325A | S330A | S330A | |

| Human STING (SEQ ID NOs: 305-309) | Boar STING (SEQ ID NO: 347) | Bat STING (SEQ ID NO: 348) | Manatee STING (SEQ ID NO: 349) | Ghost Shark STING (SEQ ID NO: 350) | Mouse STING (SEQ ID NO: 351) |
|---|---|---|---|---|---|
| S102P | S102P | S103P | S105P | S98P | S102P |
| V147L | I147L | V148L | I150L | I148L | V146L |
| V147M | I147M | V148M | I150M | I148M | V146M |
| N154S | N154S | N155S | N157S | N155S | N153S |
| V155M | V155M | V156M | V158M | V156S | V154M |
| G166E | G166E | G167E | G169E | G167E | G165E |
| C206Y | C206Y | C207Y | C209Y | C206Y | C205Y |
| G207E | G207E | G208E | G210E | K207E | G206E |
| S102P/F279L | S102P/F279L | S103P/F280L | S105P/F282L | S98P/F280L | S102P/F278L |
| F279L | F279L | F280L | F282L | F280L | F278L |
| R281Q | R281Q | — | R284Q | K282Q | R280Q |
| R284G | R284G | R285G | R287G | R285G | R283G |
| R284S | R284S | R285S | R287S | R285S | R283S |
| R284M | R284M | R285M | R287M | R285M | R283M |
| R284K | R284K | R285K | R287K | R285K | R283K |
| R284T | R284T | R285T | R287T | R285T | R283T |
| R197A | R197A | R198A | R200A | K197A | R196A |
| D205A | D205A | D206A | D208A | S205A | D204A |
| R310A | R310A | R311A | R313A | R311A | R309A |
| R293A | R293A | R294A | R296A | R294A | R292A |
| T294A | T294A | T295A | T297A | T295A | T293A |
| E296A | E296A | — | E299A | K297A | E295A |
| R197A/D205A | R197A/D205A | R198A/D206A | R200A/D208A | K197A/S205A | R196A/D204A |
| S272A/Q273A | S272A/Q273A | S273A/Q274A | S275A/Q276A | T273A/N274A | S271A/Q272A |
| R310A/E316A | R310A/E316A | R311A/E317A | R313A/E319A | R311A/D317A | R309A/E315A |
| E316A | E316A | E317A | E319A | D317A | E315A |
| E316N | E316N | E317N | E319N | D317N | E315N |
| E316Q | E316Q | E317Q | E319Q | D317Q | E315Q |
| S272A | S272A | S273A | S275A | T273A | S271A |
| R375A | S374A | R376A | R383A | R374A | R374A |
| R293A/T294A/E296A | R293A/T294A/E296A | R294A/T295A | R296A/T297A/E299A | R294A/T295A/K297A | R292A/T293A/E295A |
| D231A | D231A | D232A | D234A | D231A | D230A |
| R232A | R232A | R233A | C235A | R232A | R231A |
| K236A | K236A | K237A | K239A | K236A | K235A |
| Q273A | Q273A | Q274A | Q276A | N274A | Q272A |

-continued

| | | | | | |
|---|---|---|---|---|---|
| S358A/E360A/S366A | S357A/E359A/S365A | H359A/E361A/S367A | S366A/E368A/S374A | S359A/E361A/S367A | S357A/E359A/S365A |
| D231A/R232A/ | D231A/R232A/ | D232A/R233A/ | D234A/C235A/ | D231A/R232A/ | D230A/R231A/ |
| K236A/R238A | K236A/R238A | K237A/R239A | K239A/R241A | K236A/R238A | K235A/R237A |
| S358A | S357A | H359A | S366A | S359A | S357A |
| E360A | E359A | E361A | E368A | E361A | E359A |
| S366A | S365A | S367A | S374A | S367A | S365A |
| R238A | R238A | R239A | R241A | R238A | R237A |
| S324A/S326A | S324A/S326A | S325A/S327A | S327A/S329A | G325A/S330A | S323A/S325A |

For example, modified STING variants include Tasmanian devil STING with the mutations C206Y (SEQ ID NO:332) or R284G (SEQ ID NO:333); a variant in which the CTT of human STING is replaced with the CTT of Tasmanian devil STING (SEQ ID NO:334); human STING with the mutation C206Y (SEQ ID NO:335) or R284G (SEQ ID NO:336) and where the CTT is replaced with the CTT of Tasmanian devil STING; wild type human STING with a deletion in the TRAF6 binding domain (corresponding to residues 377-379, DFS) (SEQ ID NO:337); cat STING with the mutations C205Y (SEQ ID NO:339) or R283G (SEQ ID NO:340); and other such modified STING variants.

To determine the corresponding amino acid residues for the STING mutations, the wild type STING sequences from various non-human species each were aligned with the wild type human STING sequence (of the allelic variants of SEQ ID NO:305 (R232 allele) or SEQ ID NO:306 (H232 allele)). The alignments were performed using the Kalign sequence alignment tool, available from ebi.ac.uk/Tools/msa/kalign/, or the EMBOSS needle sequence alignment tool, available from ebi.ac.uk/Tools/psa/emboss needle/. Exemplary sequence alignments, for human STING with STING proteins from Tasmanian devil, marmoset, cattle, cat, ostrich, crested ibis, coelacanth, zebrafish, boar, bat, manatee, ghost shark and mouse species, are depicted in FIGS. 1-13.

STING GOF Hybrid Variants Demonstrate Significantly Enhanced Type I Interferon to NF-κB ratios in Dendritic Cells In order to determine the optimal STING GOF mutant that would elicit the highest levels of the $CD8^+$ T-cell chemokine CXCL10 in mice, a panel of mutants were tested in murine primary bone marrow-derived dendritic cells (BMDC). These included the Tasmanian devil STING with the constitutive human GOF mutations C206Y (SEQ ID NO:332) or R284G (SEQ ID NO:333); the murine STING GOF mutants C205Y or R283G; as well as variants in which the CTT of human STING was replaced with the CTT of Tasmanian devil STING (SEQ ID NO:334) and containing either wild-type human STING, or the human STING mutations C206Y (SEQ ID NO:335) or R284G (SEQ ID NO:336). Also included were cat STING with the mutations C205Y (SEQ ID NO:339) or R283G (SEQ ID NO:340), and human STING variants with the mutations C206Y or R284G.

To test these, murine bone marrow was isolated and flushed into 1.5 mL Eppendorf Tubes® and spun at 1200 RPM for 5 minutes to collect the bone marrow cells. Cells were washed once in RPMI-1640+10% FBS, then seeded in 6-well TC-treated plates in RPMI-1640+10% FBS with 20 ng/ml GM-CSF. Every 2 days, 50% of the medium was replaced with fresh complete media. After six days, non-adherent cells were pipetted off the wells and re-seeded at 1e5 cells per well in RPMI-1640+10% FBS in a 96-well plate for transfection. Cells were transfected using Viromer® RED, according to the manufacturer's instructions. Briefly, 200 ng of plasmid DNA from a panel of STING GOF mutants, as well as untransfected control, were diluted in the provided buffer, and mixed with 0.08 μL of Viromer® RED and incubated at room temperature for 15 minutes to allow the Viromer® complexes to form. The DNA/Viromer® RED complexes were then slowly added to each well of the 96-well plate (in duplicates) and the plate was incubated at 37° C. in a $CO_2$ incubator. Supernatants were harvested at 48 hours and assayed for murine CXCL10 (IP-10) using flow cytometry-based cytokine bead array (CBA), according to the manufacturer's protocol.

As shown in the table below, the construct that induced the highest expression of murine CXCL10 contained the CTT of human STING replaced with the CTT of Tasmanian devil STING, and contained the human STING GOF mutation R284G (huSTING R284G tazCTT). The next highest was the human STING with the GOF mutation C206Y (huSTING C206Y), and the Tasmanian devil STING containing the human STING GOF mutation R284G (tazSTING R284G). Interestingly, the human STING GOF mutants were more potent than the murine STING GOF mutants (muSTING C205Y and muSTING R283G), which were even less potent than the cat STING containing the C205Y and R283G GOF mutations, in primary murine dendritic cells.

| Construct | CXCL10 pg/mL |
|---|---|
| Untransfected | 11.48 ± 3.889 |
| huSTING C206Y | 861.0 ± 58.48 |
| huSTING R284G | 769.7 ± 95.16 |
| mSTING C205Y | 194 ± 27.15 |
| mSTING R283G | 230.1 ± 1.018 |
| huSTING C206Y taz CTT | 366.6 ± 42.61 |
| huSTING R284G taz CTT | 1326 ± 137.9 |
| tazSTING C206Y | 808.8 ± 95.78 |
| tazSTING R284G | 831.3 ± 30.15 |
| catSTING C205Y | 480.7 ± 24.94 |
| catSTING R283G | 376.2 ± 6.682 |

These data demonstrate the feasibility of utilizing STING obtained from other species such as Tasmanian devil, and combining those with constitutive GOF human STING mutations to elicit potent T-cell recruiting chemokines.

STING GOF Hybrid Variants Demonstrate Significantly Enhanced Type I Interferon to NF-κB Ratios in Human Monocytes In order to demonstrate that the ratio of STING-induced type I interferon to NF-κB signaling can be altered using STING GOF hybrid variants from other species, a panel was tested in a human monocyte cell line. The panel included wild-type human STING, or human STING with the constitutive GOF mutations C206Y or R284G; wild-type Tasmanian devil STING or Tasmanian devil STING with the constitutive GOF mutations C206Y or R284G; the variants in which the CTT of human STING was replaced with the CTT of Tasmanian devil STING, and containing either wild-type human STING or the human STING mutations C206Y or R284G; and murine and cat STING proteins with the mutations C205Y or R283G. Also included were a wild-type human STING with a deletion in the TRAF6 binding domain (corresponding to residues 377-379, DFS), cat wild-type STING, and zebrafish wild-type STING.

For this experiment, the THP1-Dual™ KO STING cells were utilized, which have been altered to lack endogenous STING, and to also express Lucia™ luciferase, a secreted luciferase, placed under the control of the endogenous IFN-β promoter. Constitutively active STING GOF mutants then were identified and ranked by measurement of IFN-β promoter induced expression of luciferase activity. These cells also express secreted embryonic alkaline phosphatase (SEAP), placed under the control of the endogenous NF-κB promoter, where the coding sequence of NF-κB has been replaced by the SEAP ORF using knock-in technology. NF-κB activity induced by STING GOF mutants can be assessed by monitoring SEAP production in the cell supernatants.

For this experiment, THP1-Dual™ KO STING cells were transfected using Viromer® RED, according to the manufacturer's instructions. Briefly, 200 ng of plasmid DNA from a panel of STING GOF mutants, as well as untransfected control, were diluted in the provided buffer, and mixed with 0.08 μL of Viromer® RED and incubated at room temperature for 15 minutes to allow the Viromer® complexes to form. The DNA/Viromer® RED complexes were then slowly added to each well of the 96-well plate (in duplicates) and the plate was incubated at 37° C. in a $CO_2$ incubator. In addition, the wild-type STING variants were treated with or without the STING agonist 3'S' RpRp c-di-AMP (CDN, InvivoGen), an analog of the clinical compound ADU-S100, added to the cells after 24 hours of incubation at 10 μg/mL. Supernatants were harvested at 48 hours and assayed for NF-κB-SEAP and IFN-Lucia reporter signals, according to the manufacturer's protocol. Briefly, 10 μL of the cell culture supernatants was added to 50 μL QUANTI-Blue™ reagent (InvivoGen) (which is used for measuring SEAP). NF-κB activation was determined by measuring NF-κB-induced SEAP activity on a SpectraMax® M3 Spectrophotometer (Molecular Devices) at an absorbance (Abs) of 650 nm. For measuring type I interferon activity from IFN-Lucia, 10 μL of the cell culture supernatants was added to 50 μL QUANTI-Luc™, containing the coelenterazine substrate for the luciferase reaction, which produces a light signal that is quantified using a SpectraMax® M3 luminometer and expressed as relative light units (RLUs).

As shown in the table below, the highest type I IFN responses were observed from the variant in which the CTT of human STING was replaced with the CTT of Tasmanian devil STING, and that contained the human STING GOF mutation R284G (huSTING R284G tazCTT), as well as from the wild-type zebrafish STING with the CDN STING agonist (zfSTING WT+CDN). However, unlike the wild-type zebrafish STING, which had very high NF-κB signaling, the huSTING R284G tazCTT variant had high type I IFN signaling with much lower NF-κB signaling activity. The best ratio of higher type I IFN to lower NF-κB signaling was found with the Tasmanian devil STING variant containing the human STING GOF mutation R284G(tazSTING R284G).

| STING Variant | ISRE-Lucia (RLU) | ±SD | NF-kB-SEAP (Abs) | ±SD |
|---|---|---|---|---|
| Untransfected | 47.96 | 33.91 | 0.065 | 0.007 |
| huSTING WT + CDN | 170.8 | 38.15 | 0.100 | 0.014 |
| huSTING WT delTRAF6 + CDN | 164.8 | 8.48 | 0.120 | 0.014 |
| huSTING WT tazCTT + CDN | 31.47 | 10.59 | 0.060 | 0.000 |
| tazSTING WT + CDN | 143.9 | 4.24 | 0.090 | 0.014 |
| zfSTING WT + CDN | 310.2 | 23.31 | 0.690 | 0.028 |
| CMV catSTING WT WPRE + CDN | 202.3 | 6.36 | 0.125 | 0.007 |
| huSTING C206Y | 175.3 | 36.03 | 0.105 | 0.007 |
| huSTING R284G | 143.9 | 29.67 | 0.100 | 0.000 |
| huSTING C206Y tazCTT | 137.9 | 21.19 | 0.095 | 0.007 |
| huSTING R284G tazCTT | 301.2 | 61.46 | 0.250 | 0.127 |
| tazSTING C206Y | 199.3 | 2.12 | 0.120 | 0.000 |
| tazSTING R284G | 217.3 | 19.08 | 0.105 | 0.007 |
| muSTING C205Y | 43.46 | 2.12 | 0.070 | 0.000 |
| muSTING R283G | 32.97 | 4.24 | 0.070 | 0.000 |
| catSTING C205Y | 202.3 | 23.31 | 0.135 | 0.007 |
| catSTING R283G | 157.4 | 10.60 | 0.120 | 0.000 |

These data further demonstrate the feasibility of using non-human STING proteins, such as the STING protein from Tasmanian devil, and combining those with human constitutive gain-of-function STING mutations, in order to enhance the beneficial type I interferon activity, while minimizing the immunosuppressive activity, in human monocytes.

Since modifications will be apparent to those of skill in the art, it is intended that this invention be limited only by the scope of the appended claims.

SEQUENCE LISTING (377 sequences)

SEQ ID NO: 1 - DNA, 19 bp, Homo sapiens
  Human PD-L1 shRNA target 1
gtagagtatggtagcaata

SEQ ID NO: 2 - DNA, 19 bp, Homo sapiens
  Human PD-L1 shRNA target 2
gccgactacaagcgaatta

SEQ ID NO: 3 - DNA, 19 bp, Homo sapiens
  Human PD-L1 shRNA target 3
gacaagcagtgaccatcaa

SEQ ID NO: 4 - DNA, 19 bp, Homo sapiens
  Human PD-L1 shRNA target 4
gaatcaacacaacaactaa

SEQ ID NO: 5 - DNA, 19 bp, Homo sapiens
  Human PD-L1 shRNA target 5
gcacatcctccaaatgaaa

SEQ ID NO: 6 - DNA, 19 bp, Homo sapiens
  Human PD-L1 shRNA target 6
gtagcactgacattcatct

SEQ ID NO: 7 - DNA, 19 bp, Homo sapiens
  Human CTNNB1 shRNA target 1
gacagactgccttcaaatt

SEQ ID NO: 8 - DNA, 19 bp, Homo sapiens
  Human CTNNB1 shRNA target 2
gcagctggaattctttcta

SEQ ID NO: 9 - DNA, 19 bp, Homo sapiens
  Human CTNNB1 shRNA target 3
gactaccagttgtggttaa

SEQ ID NO: 10 - DNA, 19 bp, Homo sapiens
  Human CTNNB1 shRNA target 4
ggacacagcagcaatttgt

SEQ ID NO: 11 - DNA, 19 bp, Homo sapiens
  Human CTNNB1 shRNA target 5
ggatgttcacaaccgaatt

SEQ ID NO: 12 - DNA, 19 bp, Homo sapiens
  Human CTNNB1 shRNA target 6
gccacaagattacaagaaa

SEQ ID NO: 13 - DNA, 19 bp, Homo sapiens
  Human SIRP-alpha shRNA target 1
gccaggtgaggaagttcta

SEQ ID NO: 14 - DNA, 19 bp, Homo sapiens
  Human SIRP-alpha shRNA target 2
gagctggctcctggtgaat

SEQ ID NO: 15 - DNA, 19 bp, Homo sapiens
  Human SIRP-alpha shRNA target 3
gctgagaacactggatcta

SEQ ID NO: 16 - DNA, 19 bp, Homo sapiens
  Human SIRP-alpha shRNA target 4
gaagaatgccagagaaata

SEQ ID NO: 17 - DNA, 19 bp, Homo sapiens
  Human SIRP-alpha shRNA target 5
ggacacaaatgatatcaca

SEQ ID NO: 18 - DNA, 19 bp, Homo sapiens
  Human SIRP-alpha shRNA target 6
ggagtatgccagcattcag

SEQ ID NO: 19 - DNA, 19 bp, Homo sapiens
  Human Trex1 shRNA target 1
gcagcgcatgggcgtcaat

SEQ ID NO: 20 - DNA, 19 bp, Homo sapiens
  Human Trex1 shRNA target 2
ggcccaaggaagagctata

SEQ ID NO: 21 - DNA, 19 bp, Homo sapiens
  Human Trex1 shRNA target 3
gcaccatcaggcccatgta

SEQ ID NO: 22 - DNA, 19 bp, Homo sapiens
  Human Trex1 shRNA target 4
gccacaaccaggaacacta

SEQ ID NO: 23 - DNA, 19 bp, Homo sapiens
  Human Trex1 shRNA target 5
gcaggggtaccaaggatct

SEQ ID NO: 24 - DNA, 19 bp, Homo sapiens
  Human Trex1 shRNA target 6
gccacactgtatggactat

SEQ ID NO: 25 - DNA, 19 bp, Homo sapiens
  Human VISTA shRNA target 1
gatgtgaccttctacaaga

SEQ ID NO: 26 - DNA, 19 bp, Homo sapiens
  Human VISTA shRNA target 2
gaccaccatggcaacttct

SEQ ID NO: 27 - DNA, 19 bp, Homo sapiens
  Human VISTA shRNA target 3
ggtgcagacaggcaaagat

SEQ ID NO: 28 - DNA, 19 bp, Homo sapiens
  Human VISTA shRNA target 4
gtgcctgcatcgtaggaat

SEQ ID NO: 29 - DNA, 19 bp, Homo sapiens
  Human VISTA shRNA target 5
gcaacattcaagggattga

SEQ ID NO: 30 - DNA, 19 bp, Homo sapiens
  Human VISTA shRNA target 6
gtccctgactctccaaact

SEQ ID NO: 31 - DNA, 870 bp, Homo sapiens
  programmed death-ligand 1 (PD-L1), isoform 1
atgaggatatttgctgtctttatattcatgacctactggcatttgctgaacgcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatgccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccagaactacctctggcacatcctccaaatgaaaggactcacttggtaattctgggagccatcttattatgccttggtgtagcactgacattcatcttccgtttaagaaaagggagaatgatggatgtgaaaaaatgtggcatccaagatacaaactcaaagaagcaaagtgatacacatttggaggagacg

SEQ ID NO: 32 - DNA, 2343 bp, Homo sapiens
  CTNNB1 (Beta-catenin), isoform 1
atggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctg

SEQ ID NO: 33 - DNA, 1512 bp, Homo sapiens
  signal regulatory protein alpha (SIRP-alpha) isoform 1
atggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaag

SEQ ID NO: 34 - DNA, 1108 bp, Homo sapiens
  TREX1 isoform 1
aatgggccctggagctcgcagacagggcaggattgtgcagggaaggcctgagatgtgcttctgcccaccccctaccccactccctccccttcggatcttaacactgggcactcacacacccaccccatgctcctctccaggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggag

SEQ ID NO: 35 - DNA, 933 bp, Homo sapiens
  V-domain Ig suppressor of T cell activation (VISTA)
atgggcgtccccacggccctggaggccggcagctggcgctggggatccctgctcttcgctctcttcctggctgcgtccctaggtccggtggcagccttcaaggtcgccacgccgtattccctgtatgtctgtcccgaggggcagaacgtcaccctcacctgcaggctcttgggccctgtggacaaagggcacgatgtgaccttctacaagacgtggtaccgcagctcgaggggcgaggtgcagacctgctcagagcgccggcccatccgcaacctcacgttccaggaccttcacctgcaccatggaggccaccaggctgccaacaccagccacgacctggctcagcgccacgggctggagtcggcctccgaccaccatggcaacttctccatcaccatgcgcaacctgaccctgctggatagcggcctctactgctgcctggtggtggagatcaggcaccaccactcggagcacagggtccatggtgccatggagctgcaggtgcagacaggcaaagatgcaccatccaactgtgtggtgtacccatcctcctcccaggatagtgaaaacatcacggctgcagccctggctacgggtgcctgcatcgtaggaatcctctgcctccccctcatcctgctcctggtctacaagcaaaggcaggcagcctccaaccgccgtgcccaggagctggtgcggatggacagcaacattcaagggattgaaaaccccggctttgaagcctcaccacctgcccaggggatacccgaggccaaagtcaggcaccccctgtcctatgtggcccagcggcagccttctgagtctgggcggcatctgctttcggagcccagcacccccctgtctcctccaggccccggagacgtcttcttcccatccctggaccctgtccctgactctccaaactttgaggtcatc

SEQ ID NO: 36 - DNA, 45 bp, Artificial Sequence
  shRNA-encoding sequence for huPD-L1
gtagagtatggtagcaatatctagagtattgctaccatactctac

SEQ ID NO: 37 - DNA, 45 bp, Artificial Sequence
  shRNA-encoding sequence for huCTNNB1
gacagactgccttcaaatttctagagaatttgaaggcagtctgtc

SEQ ID NO: 38 - DNA, 45 bp, Artificial Sequence
  shRNA-encoding sequence for huSIRPalpha
gccaggtgaggaagttctatctagagtagaacttcctcacctggc

SEQ ID NO: 39 - DNA, 45 bp, Artificial Sequence
  shRNA-encoding sequence for huTREX1
gcagcgcatgggcgtcaattctagagattgacgcccatgcgctgc

SEQ ID NO: 40 - DNA, 45 bp, Artificial Sequence
  shRNA-encoding sequence for huVISTA
gaccaccatggcaacttcttctagagagaagttgccatggtggtc

SEQ ID NO: 41 - DNA, 3220 bp, Artificial Sequence
  pEQU6 vector
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgactggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagttttttctcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 42 - DNA, 3802 bp, Artificial Sequence
  pEQU6-H1 Vector
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggtttttgtcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagttttttctcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 43 - DNA, 3263 bp, Artificial Sequence
  pEQU6-shPDL1-shRNA Vector
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgactggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 44 - DNA, 3888 bp, Artificial Sequence
  pEQU6-shPDL1-H1-shCTNNB1 Vector
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggacagactgccttcaaatttctagagaatttgaaggcagtctgtcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 45 - DNA, 3888 bp, Artificial Sequence
  pEQU6-shPDL1-H1-shSIRPalpha Vector
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggccaggtgaggaagttctatctagagtagaacttcctcacctggcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 46 - DNA, 3888 bp, Artificial Sequence
  pEQU6-shPDL1-H1-shTREX1
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggcagcgcatgggcgtcaattctagagattgacgcccatgcgctgcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 47 - DNA, 3888 bp, Artificial Sequence
  pEQU6-shPDL1-H1-shVISTA
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggaccaccatggcaacttcttctagagagaagttgccatggtggtcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 48 - DNA, 1104 bp, Salmonella typhimurium
  Strain LT2 Aspartate-semialdehyde dehydrogenase (asd)
atgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgatgcggcttctacgctgcgcatgaaagatgatgccattattattctcgacccggtcaaccaggacgtgattaccgacggcctgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccagatgggtcagttgtatggccatgtcgccgatgaactggcgacgccgtcttccgcaattcttgatattgaacgcaaagttacggcattgacccgcagcggcgagctgccggttgataactttggcgtaccgctggcgggaagcctgatcccctggatcgacaaacagctcgataacggccagagccgcgaagagtggaaaggccaggcggaaaccaacaagattctcaatactgcctctgtgattccggttgatggtttgtgtgtgcgcgtcggcgcgctgcgctgtcacagccaggcgttcaccatcaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcg

SEQ ID NO: 49 - DNA, 861 bp, Salmonella typhimurium
  Strain LT2 TSX
atgaaaaaaactttactcgcagtcagcgcagcgctggcgctcacctcatcttttactgctaacgcagcagaaaatgatcagccgcagtatttgtccgactggtggcaccagagcgtaaacgtggtaggcagctaccatacccgtttctcgccgaaattgaacaacgacgtctatctggaatatgaagcatttgccaaaaaagactggtttgatttctacggctatatcgatattcccaaaacctttgattggggtaacggcaacgataaaggtatctggtccgacggttctccgctgttcatggaaatcgaaccgcgtttctcaattgataagctgaccggcgcagacctgagcttcggcccgtttaaagagtggtatttcgccaacaactacatctacgatatgggcgataacaaagccagccgccagagcacgtggtatatgggtctggggaccgatatcgacaccggcctgccgatgggtctgtcgctgaacgtgtatgcgaaatatcagtggcaaaactacggcgcgtccaatgaaaacgaatgggacggctaccgtttcaaagtgaaatacttcgtccccatcaccgatctgtggggcggtaaactgagctatatcggctttaccaactttgactggggatctgatttaggcgacgatccgaaccgtaccagcaactccatcgcttccagccatatcctggcgctgaactacgatcactggcactactcggtcgttgcgcgttacttccataacggcggacagtggcagaatggcgcaaaactgaactggggcgacggcgatttcagcgcgaaatctaccggctggggcggctacctggtcgtgggttacaacttc

SEQ ID NO: 50 - DNA, 864 bp, Homo sapiens
  programmed cell death protein 1 (PD-1)
atgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctc

SEQ ID NO: 51 - DNA, 933 bp, Homo sapiens
  programmed cell death protein 2 (PD-2), isoform 1
atggctgccgccggggccaggcctgtggagctgggcttcgccgagtcggcgccggcgtggcgactgcgcagcgagcagttccccagcaaggtgtatgcgccgctgcctggccgcccggacgccttccaccgctgcatcttcctcttctgctgccgcgagcagccgtgctgtgccggcctgcgagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccagatcatctggaccatataattccagaccacaacttcctttttccagaatttgaaattgtaatagaaacagaagatgagattatgcctgaggttgtggaaaaggaagattactcagagattatagggagcatgggtgaagcacttgaggaagaactggattccatggcaaaacatgaatccagggaagataaaatttttcagaagtttaaaactcagatagcccttgaaccagaacagattcttagatatggcagaggtattgcccccatctggatttctggtgaaaatattcctcaagaaaaggatattccagattgcccctgtggtgccaagagaatattggaattccaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccg

SEQ ID NO: 52 - DNA, 819 bp, Homo sapiens
  programmed death-ligand 2 (PD-L2), isoform 1
atgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatc

SEQ ID NO: 53 - DNA, 669 bp, Homo sapiens
  cytotoxic T-lymphocyte-associated protein 4 (CTLA-4), isoform 1
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaat

SEQ ID NO: 54 - DNA, 969 bp, Homo sapiens
  CD47 transcript variant 1
atgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaa

SEQ ID NO: 55 - DNA, 1209 bp, Homo sapiens
  indoleamine 2,3-dioxygenase (IDO) 1
atggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaaaggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggt

SEQ ID NO: 56 - DNA, 1260 bp, Homo sapiens
  indoleamine 2,3-dioxygenase (IDO) 2
atgttgcattttcattattatgatacttcaaacaaaataatggagccccacagaccgaatgtgaagacagcagtgccattgtctttggaaagctatcacatatctgaagagtatggctttcttcttccagattctctgaaagaacttccagatcattataggccttggatggaaattgccaacaaacttcctcaattgattgatgctcaccagcttcaagctcatgtggacaagatgcccctgctgagctgccagttcctgaagggtcaccgggagcagcgcctggcccacctggtcctgagcttcctcaccatgggttatgtctggcaggaaggagaggcgcagcctgcagaggtcctgccaaggaatcttgcccttccatttgtcgaagtctccaggaacttggggctccctcctatcctggtccactcagacttggtgctgacgaactggaccaaaaaagatccagacggattcctggaaattgggaacctggagaccatcatctcatttcctgggggagagagcctgcatggttttatactggtgactgctttggtagagaaagaagcagtgcctgggataaaggctcttgttcaggccacgaatgctatcttgcagcccaaccaggaggccctgctccaagccctgcagcgactgagactgtctattcaggacatcaccaaaaccttaggacagatgcatgattatgtagatccagacatattttatgcaggcatccggatctttctctctggatggaaagacaacccagcaatgcctgcagggctgatgtatgaaggagtttcccaagagcccctgaaatactccggcgggagtgcagctcagagcacagtgcttcatgcctttgatgagttcttaggcattcgtcatagcaaggaaagtggtgactttctgtacagaatgagggattacatgcctccttcccataaggccttcatagaagacatccactcagcaccttccctgagggactacatcctgtcatctggacaggaccacttgctgacagcttataaccagtgtgtgcaggccctggcagagctgcggagctatcacatcaccatggtcaccaaatacctcatcacagctgcagccaaggcaaagcatgggaagccaaaccatctcccagggcctcctcaggctttaaaagacaggggcacaggtggaaccgcagttatgagctttcttaagagtgtcagggataagaccttggagtcaatccttcacccacgtggt

SEQ ID NO: 57 - DNA, 2310 bp, Homo sapiens
  signal transducer and activator of transcription 3 (STAT3)
atggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatg

SEQ ID NO: 58 - DNA, 1575 bp, Homo sapiens
  lymphocyte-activation gene 3 (LAG3)
atgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctc

SEQ ID NO: 59 - DNA, 903 bp, Homo sapiens
  T cell immunoglobulin and mucin-domain containing-3 (TIM-3)
atgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgcca

SEQ ID NO: 60 - DNA, 732 bp, Homo sapiens
  T cell immunoreceptor with Ig and ITIM domains (TIGIT), isoform 1
atgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggt

SEQ ID NO: 61 - DNA, 1065 bp, Homo sapiens
  GALECTIN-9/LGALS9, isoform 1
atggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagaca

SEQ ID NO: 62 - DNA, 720 bp, Homo sapiens
  LIGHT/TNSF14
atggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggccgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggagaaggtggtcgtccgtgtgctggatgaacgcctggttcgactgcgtgatggtacccggtcttacttcggggctttcatggtg

SEQ ID NO: 63 - DNA, 849 bp, Homo sapiens
  HVEM/TNSFR14 (receptor for LIGHT ligand)
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccac

SEQ ID NO: 64 - DNA, 660 bp, Homo sapiens
  CD28
atgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcc

SEQ ID NO: 65 - DNA, 1578 bp, Homo sapiens
  carcinoembryonic antigen-related cell adhesion molecule 1 (CEACAM1, or CD66a)
atggggcacctctcagccccacttcacagagtgcgtgtaccctggcaggggcttctgctcacagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtatacccggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactgagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactataatgctctaccacaagaaaatggcctctcacctggggccattgctggcattgtgattggagtagtggccctggttgctctgatagcagtagccctggcatgttttctgcatttcgggaagaccggcagggcaagcgaccagcgtgatctcacagagcacaaaccctcagtctccaaccacactcaggaccactccaatgacccacctaacaagatgaatgaagttacttattctaccctgaactttgaagcccagcaacccacacaaccaacttcagcctccccatccctaacagccacagaaataatttattcagaagtaaaaaagcag

SEQ ID NO: 66 - DNA, 864 bp, Homo sapiens
  CD80/B7-1
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgta

SEQ ID NO: 67 - DNA, 995 bp, Homo sapiens
  CD86/B7-2
cagccaaaatggatccccagtgcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttt

SEQ ID NO: 68 - DNA, 1095 bp, Homo sapiens
  CD244/2B4
atgctggggcaagtggtcaccctcatactcctcctgctcctcaaggtgtatcagggcaaaggatgccagggatcagctgaccatgtggttagcatctcgggagtgcctcttcagttacaaccaaacagcatacagacgaaggttgacagcattgcatggaagaagttgctgccctcacaaaatggatttcatcacatattgaagtgggagaatggctctttgccttccaatacttccaatgatagattcagttttatagtcaagaacttgagtcttctcatcaaggcagctcagcagcaggacagtggcctctactgcctggaggtcaccagtatatctggaaaagttcagacagccacgttccaggtttttgtatttgataaagttgagaaaccccgcctacaggggcaggggaagatcctggacagagggagatgccaagtggctctgtcttgcttggtctccagggatggcaatgtgtcctatgcttggtacagagggagcaagctgatccagacagcagggaacctcacctacctggacgaggaggttgacattaatggcactcacacatatacctgcaatgtcagcaatcctgttagctgggaaagccacaccctgaatctcactcaggactgtcagaatgcccatcaggaattcagattttggccgtttttggtgatcatcgtgattctaagcgcactgttccttggcacccttgcctgcttctgtgtgtggaggagaaagaggaaggagaagcagtcagagaccagtcccaaggaatttttgacaatttacgaagatgtcaaggatctgaaaaccaggagaaatcacgagcaggagcagacttttcctggaggggggagcaccatctactctatgatccagtcccagtcttctgctcccacgtcacaagaacctgcatatacattatattcattaattcagccttccaggaagtctggatccaggaagaggaaccacagcccttccttcaatagcactatctatgaagtgattggaaagagtcaacctaaagcccagaaccctgctcgattgagccgcaaagagctggagaactttgatgtttattcc

SEQ ID NO: 69 - DNA, 1251 bp, Homo sapiens
  CD155/PVR
atggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatgtcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaagg

SEQ ID NO: 70 - DNA, 1614 bp, Homo sapiens
  CD122/nectin-2
atggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccgaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtg

SEQ ID NO: 71 - DNA, 1008 bp, Homo sapiens
  CD226 antigen
atggattatcctactttacttttggctcttcttcatgtatacagagctctatgtgaagaggtgctttggcatacatcagttccctttgccgagaacatgtctctagaatgtgtgtatccatcaatgggcatcttaacacaggtggagtggttcaagatcgggacccagcaggattccatagccattttcagccctactcatggcatggtcataaggaagccctatgctgagagggtttactttttgaattcaacgatggcttccaataacatgactcttttctttcggaatgcctctgaagatgatgttggctactattcctgctctctttacacttacccacagggaacttggcagaaggtgatacaggtggttcagtcagatagttttgaggcagctgtgccatcaaatagccacattgtttcggaacctggaaagaatgtcacactcacttgtcagcctcagatgacgtggcctgtgcaggcagtgaggtgggaaaagatccagccccgtcagatcgacctcttaacttactgcaacttggtccatggcagaaatttcacctccaagttcccaagacaaatagtgagcaactgcagccacggaaggtggagcgtcatcgtcatccccgatgtcacagtctcagactcggggctttaccgctgctacttgcaggccagcgcaggagaaaacgaaaccttcgtgatgagattgactgtagccgagggtaaaaccgataaccaatataccctctttgtggctggagggacagttttattgttgttgtttgttatctcaattaccaccatcattgtcattttccttaacagaaggagaaggagagagagaagagatctatttacagagtcctgggatacacagaaggcacccaataactatagaagtcccatctctaccagtcaacctaccaatcaatccatggatgatacaagagaggatatttatgtcaactatccaaccttctctcgcagaccaaagactagagtt

SEQ ID NO: 72 - DNA, 545 bp, Homo sapiens
  CD160 antigen
ggatgctgttggaacccggcagaggctgctgtgccctggccatcctgctggcaattgtggacatccagtctggtggatgcattaacatcaccagctcagcttcccaggaaggaacgcgactaaacttaatctgtactgtatggcataagaaagaagaggctgaggggtttgtagtgtttttgtgcaaggacaggtctggagactgttctcctgagaccagtttaaaacagctgagacttaaaagggatcctgggatagatggtgttggtgaaatatcatctcagttgatgttcaccataagccaagtcacaccgttgcacagtgggacctaccagtgttgtgccagaagccagaagtcaggtatccgccttcagggccattttttctccattctattcacagagacagggaactacacagtgacgggattgaaacaaagacaacaccttgagttcagccataatgaaggcactctcagttcaggcttcctacaagaaaaggtctgggtaatgctggtcaccagccttgtggcccttcaagctttg

SEQ ID NO: 73 - DNA, 264 bp, Homo sapiens
  human U6 RNA Pol III promoter
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactag

SEQ ID NO: 74 - DNA, 99 bp, Homo sapiens
  human H1 RNA Pol III promoter
atatttgcatgtcgctatgtgttctgggaaatcaccataaacgtgaaatgtctttggatttgggaatcttataagttctgtatgagaccactccctagg

SEQ ID NO: 75 - DNA, 58 bp, Artificial Sequence
  shRNA-encoding sequence targeting muPD-L1
ccggccgaaatgatacacaattcgactcgagtcgaattgtgtatcatttcggtttttg

SEQ ID NO: 76 - DNA, 57 bp, Artificial Sequence
  shRNA-encoding sequence targeting muSIRPA
ccggccacaactggaatgtcttcatctcgagatgaagacattccagttgtggttttt

SEQ ID NO: 77 - DNA, 58 bp, Artificial Sequence
  shRNA-encoding sequence targeting muTREX1, clone 1
ccggacaaccaacctaaggccacatctcgagatgtggccttaggttggttgttttttg

SEQ ID NO: 78 - DNA, 58 bp, Artificial Sequence
  shRNA-encoding sequence targeting muTREX1, clone 2
ccggcctagatggtaccttctgtgtctcgagacacagaaggtaccatctaggtttttg

SEQ ID NO: 79 - DNA, 3966 bp, Artificial Sequence
  Vector1-human shTREX1-1_shPDL1-1
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccttaaaggaaccaattcagtcgagaattggtaccatatttgcatgtcgctatgtgttctgggaaatcaccataaacgtgaaatgtctttggatttgggaatcttataagttctgtatgagaccactccctaggcagcgcatgggcgtcaattctagagattgacgcccatgcgctgcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggtagagtatggtagcaatatctagagtattgctaccatactctacttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagccatccagctgatatcccatggtcatagctgtttcctggcagctctggcccgtgtctcaaaatctctgatgttacattgcacaagataaaaatatatcatcatgaacaataaaactgtctgcttacataaacagtaatacaaggggtgttatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgatgcggcttctacgctgcgcatgaaagatgatgccattattattctcgacccggtcaaccaggacgtgattaccgacggcctgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccagatgggtcagttgtatggccatgtcgccgatgaactggcgacgccgtcttccgcaattcttgatattgaacgcaaagttacggcattgacccgcagcggcgagctgccggttgataactttggcgtaccgctggcgggaagcctgatcccctggatcgacaaacagctcgataacggccagagccgcgaagagtggaaaggccaggcggaaaccaacaagattctcaatactgcctctgtgattccggttgatggtttgtgtgtgcgcgtcggcgcgctgcgctgtcacagccaggcgttcaccatcaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtagtcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 80 - DNA, 3972 bp, Artificial Sequence
  Vector2-mouse shTREX1-1_shPDL1-1
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggcccttaaaggaaccaattcagtcgagaattggtaccatatttgcatgtcgctatgtgttctgggaaatcaccataaacgtgaaatgtctttggatttgggaatcttataagttctgtatgagaccactccctagacaaccaacctaaggccacatctcgagatgtggccttaggttggttgtttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagccgaaatgatacacaattcgactcgagtcgaattgtgtatcatttcggttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagccatccagctgatatcccatggtcatagctgtttcctggcagctctggcccgtgtctcaaaatctctgatgttacattgcacaagataaaaatatatcatcatgaacaataaaactgtctgcttacataaacagtaatacaaggggtgttatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgatgcggcttctacgctgcgcatgaaagatgatgccattattattctcgacccggtcaaccaggacgtgattaccgacggcctgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccagatgggtcagttgtatggccatgtcgccgatgaactggcgacgccgtcttccgcaattcttgatattgaacgcaaagttacggcattgacccgcagcggcgagctgccggttgataactttggcgtaccgctggcgggaagcctgatcccctggatcgacaaacagctcgataacggccagagccgcgaagagtggaaaggccaggcggaaaccaacaagattctcaatactgcctctgtgattccggttgatggtttgtgtgtgcgcgtcggcgcgctgcgctgtcacagccaggcgttcaccatcaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtagtcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 81 - DNA, 1281 bp, Salmonella typhimurium
  aroA
atggaatccctgacgttacaacccatcgcgcgggtcgatggcgccattaatttacctggctccaaaagtgtttcaaaccgtgctttgctcctggcggctttagcttgtggtaaaaccgctctgacgaatctgctggatagcgatgacgtccgccatatgctcaatgccctgagcgcgttggggatcaattacaccctttctgccgatcgcacccgctgtgatatcacgggtaatggcggcgcattacgtgcgccaggcgctctggaactgtttctcggtaatgccggaaccgcgatgcgtccgttagcggcagcgctatgtctggggcaaaatgagatagtgttaaccggcgaaccgcgtatgaaagagcgtccgataggccatctggtcgattcgctgcgtcagggcggggcgaatattgattacctggagcaggaaaactatccgcccctgcgtctgcgcggcggttttaccggcggcgacattgaggttgatggtagcgtttccagccagttcctgaccgctctgctgatgacggcgccgctggcccctaaagacacaattattcgcgttaaaggcgaactggtatcaaaaccttacatcgatatcacgctaaatttaatgaaaacctttggcgtggagatagcgaaccaccactaccaacaatttgtcgtgaagggaggtcaacagtatcactctccaggtcgctatctggtcgagggcgatgcctcgtcagcgtcctattttctcgccgctggggcgataaaaggcggcacggtaaaagtgaccggaattggccgcaaaagtatgcagggcgatattcgttttgccgatgtgctggagaaaatgggcgcgaccattacctggggcgatgattttattgcctgcacgcgcggtgaattgcacgccatagatatggatatgaaccatattccggatgcggcgatgacgattgccaccacggcgctgtttgcgaaaggaaccacgacgttgcgcaatatttataactggcgagtgaaagaaaccgatcgcctgttcgcgatggcgaccgagctacgtaaagtgggcgctgaagtcgaagaagggcacgactatattcgtatcacgccgccggcgaagctccaacacgcggatattggcacgtacaacgaccaccgtatggcgatgtgcttctcactggtcgcactgtccgatacgccagttacgatcctggaccctaaatgtaccgcaaaaacgttccctgattatttcgaacaactggcgcgaatgagtacgcctgcc

SEQ ID NO: 82 - DNA, 1094 bp, Salmonella typhimurium
  aroC
acggagccgtgatggcaggaaacacaattggacaactctttcgcgtaaccactttcggcgaatcacacgggctggcgcttgggtgtatcgtcgatggcgtgccgcccggcatcccgttgacggaggccgatctgcaacacgatctcgacagacgccgccccggcacctcgcgctatactacccagcgccgcgaaccggaccaggtaaaaattctctccggcgtgtttgatggcgtgacgaccggcaccagcattggcctactgattgaaaacaccgatcagcgctcgcaggactacagcgcgattaaagatgtttttcgtccgggacacgcggattacacctatgagcagaaatacggcctgcgcgattaccgtggcggtggacgttcttccgcgcgtgaaaccgcgatgcgcgtagcggcaggggcgatcgccaagaaatacctggcggaaaagttcggcatcgaaatccgcggctgcctgacccagatgggcgacattccgctggagattaaagactggcgtcaggttgagcttaatccgttcttttgtcccgatgcggacaaacttgacgcgctggacgaactgatgcgcgcgctgaaaaaagagggtgactccatcggcgcgaaagtgacggtgatggcgagcggcgtgccggcagggcttggcgaaccggtatttgaccgactggatgcggacatcgcccatgcgctgatgagcattaatgcggtgaaaggcgtggagatcggcgaaggatttaacgtggtggcgctgcgcggcagccagaatcgcgatgaaatcacggcgcagggttttcagagcaaccacgctggcggcatcctcggtggcatcagtagcgggcaacacattgtggcgcatatggcgctgaaacctacctccagcattaccgtgccgggacgtacgatcaaccgggcaggtgaagaagtcgaaatgatcaccaaagggcgccacgatccgtgtgtggggattcgcgcagtgccgatcgcagaagccatgctggcgatcgtgctgatggatcacctgctgcgccatcgggcacagaatgcggatgtaaagacagagattccacgctgg

SEQ ID NO: 83 - DNA, 767 bp, Salmonella typhimurium
  aroD
aagggtaccaaatgaaaaccgtaactgtaagagatctcgtggttggcgaaggcgcgccaaagatcattgtgtcgctaatgggaaaaaccattaccgatgtgaaatcggaagcactcgcctaccgtgaagcggatttcgatattctggagtggcgcgttgaccattttgccaacgtgacaacggcggaaagcgtacttgaggccgccggcgccatccgggagattattaccgataaacccttgctatttaccttccgcagcgcgaaagaaggcggcgaacaggcgctaaccaccggacagtatatcgatctgaatcgtgcagcggttgacagcggtctggtcgatatgatcgatcttgagctttttaccggcgacgatgaggtgaaagccaccgtcggctatgctcatcaacacaatgttgcggtgatcatgtctaaccatgattttcataaaacgcccgcagcggaagagattgttcagcgtctgcgtaaaatgcaggaactgggcgctgatattccgaagatcgccgtcatgccacagactaaagccgatgtcctgaccttacttaccgccactgtagaaatgcaggagcgctatgcggatcgtccgattattaccatgtcgatgtcgaaaaccggggtaatatctcgtcttgccggcgaagtgttcggttctgcggcaacgtttggcgcggtgaaaaaagcatctgcgccgggacaaatatcggtagccgatctgcgtaccgtattaactatattgcaccaggcg

SEQ ID NO: 84 - DNA, 684 bp, Salmonella typhimurium
  PhoP
aagggagaagagatgatgcgcgtactggttgtagaggataatgcattattacgccaccacctgaaggttcagctccaggattcaggtcaccaggtcgatgccgcagaagatgccagggaagctgattactaccttaatgaacaccttccggatatcgctattgtcgatttaggtctgccggatgaagacggcctttccttaatacgccgctggcgcagcagtgatgtttcactgccggttctggtgttaaccgcgcgcgaaggctggcaggataaagtcgaggttctcagctccggggccgatgactacgtgacgaagccattccacatcgaagaggtaatggcgcgtatgcaggcgttaatgcgccgtaatagcggtctggcctcccaggtgatcaacatcccgccgttccaggtggatctctcacgccgggaattatccgtcaatgaagaggtcatcaaactcacggcgttcgaatacaccattatggaaacgcttatccgtaacaacggtaaagtggtcagcaaagattcgctgatgcttcagctgtatccggatgcggaactgcgggaaagtcataccattgatgttctcatggggcgtctgcggaaaaaaatacaggcccagtatccgcacgatgtcattaccaccgtacgcggacaaggatatctttttgaattgcgc

SEQ ID NO: 85 - DNA, 1461 bp, Salmonella typhimurium
  PhoQ
atgaataaatttgctcgccattttctgccgctgtcgctgcgggttcgttttttgctggcgacagccggcgtcgtgctggtgctttctttggcatatggcatagtggcgctggtcggctatagcgtaagttttgataaaaccacctttcgtttgctgcgcggcgaaagcaacctgttttataccctcgccaaatgggaaaataataaaatcagcgttgagctgcctgaaaatctggacatgcaaagcccgaccatgacgctgatttacgatgaaacgggcaaattattatggacgcagcgcaacattccctggctgattaaaagcattcaaccggaatggttaaaaacgaacggcttccatgaaattgaaaccaacgtagacgccaccagcacgctgttgagcgaagaccattccgcgcaggaaaaactcaaagaagtacgtgaagatgacgatgatgccgagatgacccactcggtagcggtaaatatttatcctgccacggcgcggatgccgcagttaaccatcgtggtggtcgataccattccgatagaactaaaacgctcctatatggtgtggagctggttcgtatacgtgctggccgccaatttactgttagtcattcctttactgtggatcgccgcctggtggagcttacgccctatcgaggcgctggcgcgggaagtccgcgagcttgaagatcatcaccgcgaaatgctcaatccggagacgacgcgtgagctgaccagccttgtgcgcaaccttaatcaactgctcaaaagcgagcgtgaacgttataacaaataccgcacgaccctgaccgacctgacgcacagtttaaaaacgccgctcgcggttttgcagagtacgttacgctctttacgcaacgaaaagatgagcgtcagcaaagctgaaccggtgatgctggaacagatcagccggatttcccagcagatcggctattatctgcatcgcgccagtatgcgcggtagcggcgtgttgttaagccgcgaactgcatcccgtcgcgccgttgttagataacctgatttctgcgctaaataaagtttatcagcgtaaaggggtgaatatcagtatggatatttcaccagaaatcagttttgtcggcgagcaaaacgactttgtcgaagtgatgggcaacgtactggacaacgcttgtaaatattgtctggagtttgtcgagatttcggctcgccagaccgacgatcatttgcatattttcgtcgaagatgacggcccaggcattccccacagcaaacgttccctggtgtttgatcgcggtcagcgcgccgataccctacgaccaggacaaggcgtggggctggctgtcgcgcgcgagattacggaacaatacgccgggcagatcattgccagcgacagtctgctcggtggcgcccgtatggaggtcgtttttggccgacagcatcccacacagaaagaggaa

SEQ ID NO: 86 - DNA, 2731 bp, Salmonella typhimurium
  Adenylate cyclase (cyaA)
tctttctttacggtcaatgagcaaggtgttaaattgatcacgttttagaccattttttcgtcggtattagataaaaatatgcaggcgagaaagggtaacggttatttttgacatacggtttatcccgaatggcgacggtcaagtactgacctgcaccatgacgggtagcaacatcaggcgatacgtcttgtacctctatattgagactctgaaacagagactggatgccataaatcaactgcgtgtggatcgcgcgcttgctgccatgggacccgcttttcagcaggtttacagtcttctgccgacattattgcactatcaccatccactgatgccgggttaccttgatggtaacgttcccagcggtatttgcttctacacgcctgatgaaacccaacgccactatctgaacgaacttgagctgtaccgcggtatgacgccgcaggacccgccgaagggcgagctgccgattaccggcgtttacaccatgggcagcacctcctcggtcgggcagagctgctcgtccgacctggatatctgggtgtgccatcagtcctggctcgacggcgaagagcgtcagttgctgcaacgtaagtgtagcctgctggaaagctgggccgcctcgcttggcgttgaggtgagcttcttcctgatcgacgagaaccgtttccgccataacgaaagcggcagtctgggcggggaagactgtggttctacgcagcatatcctgttgcttgatgagttttatcgtaccgctgtgcgcctggccgggaagcgtatcctgtggagtatggtgccgtgcgacgaagaagagcattacgacgactatgtcatgacgctctatgcgcagggcgtattaacgccaaacgaatggctggatctggggggcttaagctcgctctccgccgaagagtactttggcgccagcctgtggcagctatacaagagcattgactcgccgtacaaagcggtgctgaaaacgctgctgctggaagcctattcatgggaatatcctaacccacgtctgctggcgaaagatattaaacaacgtctgcatgacggtgaaatcgtatcgtttggactcgatccctactgcatgatgctggaacgggtcactgaatacctgacggcgattgaagatccgacgcggctggatttagtccgccgctgcttttacctgaaagtgtgcgagaaattaagtcgcgagcgtgcctgcgtaggctggcgtcgggaagtattaagccagttagtcagcgagtggggatgggacgacgcgcgtctgaccatgctcgataatcgcgcaaactggaaaatcgatcaggtgcgcgaagcccacaacgaattgctcgacgccatgatgcaaagctatcgtaatctgattcgctttgcgcggcgcaacaacctcagcgtgagtgccagcccgcaggatatcggcgtactgacgcgtaagctgtacgcggcttttgaagcgttgccgggtaaagtcacgctggtgaacccgcagatatcgccggatctgtccgagccgaatttaacctttatccatgtgccgccgggacgcgccaaccgttcaggctggtatctctacaaccgcgcgccgaacatggattccatcatcagccatcagccgctggaatataaccgttatcttaataagctggtcgcgtgggcgtggttcaacggcctgctgacgtcgcgaacgcatctgtttattaagggcaacggtattgtcgacctgcctaagttacaggagatggtcgccgatgtttcgcaccatttcccgctgcgcttgcctgctccgacgccgaaagcgctctacagcccctgtgaaattcgccatctggcgattatcgttaacctcgaatatgacccgacggcggcgtttcgcaataaagtggtccattttgacttccgtaagctggacgttttcagctttggcgaagagcaaaactgtctgataggcagtatcgacttgttatatcgcaactcgtggaacgaagtgcgtactctgcactttaacggcgagcaggcgatgatcgaagcgctgaaaacgattctggggaaaatgcaccaggatgccgcgccgccggatagcgtggaggtgttctgctacagtcagcatcttcgcggcctgattcgcacccgtgtgcagcaactggtctccgaatgtattgagctacgtctttccagcacccgtcaggagaccggtcgcttcaaggcgctgcgggtttccgggcagacgtgggggctattcttcgaacgcttgaatgtctcggtgcagaagctggagaacgctatcgaattctacggcgcgatttcgcataacaagctgcacgggctgtcggtacaggtggaaaccaaccaggtgaaattgccgtcagtggtggatggcttcgccagcgaagggattatccagttcttctttgaagaaacaggcgatgagaaaggctttaacatttatattctggatgaaagtaaccgggcggaagtatatcaccactgcgaaggtagcaaggaagaactggtgcgcgacgtcagtcgcttctattcgtcatcgcacgatcgcttcacgtatggctccagttttatcaactttaacctgccgcagttctaccagatagtgaaaaccgatggccgcgcgcaggtgatcccattccgtacgcagcctatcaacaccgtgccgccagcaaaccaggatcatgacgcgccgctattgcagcagtatttttcg

SEQ ID NO: 87 - DNA, 826 bp, Salmonella typhimurium
  cAMP-activated global transcriptional regulator (crp)
aagctatgctaaaacagacaagatgctacagtaatacattgacgtactgcatgtatgcagaggacatcacattacaggctacaatctattttcgtagcccccttcccaggtagcgggaagtatatttttgcaaccccagagacagtgccgttttctggctctggagacagcttataacagaggataaccgcgcatggtgcttggcaaaccgcaaacagacccgactcttgaatggttcttgtctcattgccacattcataagtacccgtcaaagagcacgctgattcaccagggtgaaaaagcagaaacgctgtactacatcgttaaaggctccgtggcagtgctgatcaaagatgaagaagggaaagaaatgatcctttcttatctgaatcagggtgattttattggtgaactgggcctgtttgaagaaggccaggaacgcagcgcctgggtacgtgcgaaaaccgcatgtgaggtcgctgaaatttcctacaaaaaatttcgccaattaatccaggtcaacccggatattctgatgcgcctctcttcccagatggctcgtcgcttacaagtcacctctgaaaaagtaggtaacctcgccttccttgacgtcaccgggcgtatcgctcagacgctgctgaatctggcgaaacagcccgatgccatgacgcacccggatgggatgcagatcaaaatcactcgtcaggaaatcggccagatcgtcggctgctcccgcgaaaccgttggtcgtattttgaaaatgctggaagatcaaaacctgatctccgcgcatggcaagaccatcgtcgtctacggcacccgttaa

SEQ ID NO: 88 - DNA, 1566 bp, Homo sapiens
  cyclic GMP-AMP (cGAMP) synthase (cGAS), isoform 1
atgcagccttggcacggaaaggccatgcagagagcttccgaggccggagccactgcccccaaggcttccgcacggaatgccaggggcgccccgatggatcccaccgagtctccggctgcccccgaggccgccctgcctaaggcgggaaagttcggccccgccaggaagtcgggatcccggcagaaaaagagcgccccggacacccaggagaggccgcccgtccgcgcaactggggcccgcgccaaaaaggcccctcagcgcgcccaggacacgcagccgtctgacgccaccagcgcccctggggcagaggggctggagcctcctgcggctcgggagccggctctttccagggctggttcttgccgccagaggggcgcgcgctgctccacgaagccaagacctccgcccgggccctgggacgtgcccagccccggcctgccggtctcggcccccattctcgtacggagggatgcggcgcctggggcctcgaagctccgggcggttttggagaagttgaagctcagccgcgatgatatctccacggcggcggggatggtgaaaggggttgtggaccacctgctgctcagactgaagtgcgactccgcgttcagaggcgtcgggctgctgaacaccgggagctactatgagcacgtgaagatttctgcacctaatgaatttgatgtcatgtttaaactggaagtccccagaattcaactagaagaatattccaacactcgtgcatattactttgtgaaatttaaaagaaatccgaaagaaaatcctctgagtcagtttttagaaggtgaaatattatcagcttctaagatgctgtcaaagtttaggaaaatcattaaggaagaaattaacgacattaaagatacagatgtcatcatgaagaggaaaagaggagggagccctgctgtaacacttcttattagtgaaaaaatatctgtggatataaccctggctttggaatcaaaaagtagctggcctgctagcacccaagaaggcctgcgcattcaaaactggctttcagcaaaagttaggaagcaactacgactaaagccattttaccttgtacccaagcatgcaaaggaaggaaatggtttccaagaagaaacatggcggctatccttctctcacatcgaaaaggaaattttgaacaatcatggaaaatctaaaacgtgctgtgaaaacaaagaagagaaatgttgcaggaaagattgtttaaaactaatgaaataccttttagaacagctgaaagaaaggtttaaagacaaaaaacatctggataaattctcttcttatcatgtgaaaactgccttctttcacgtatgtacccagaaccctcaagacagtcagtgggaccgcaaagacctgggcctctgctttgataactgcgtgacatactttcttcagtgcctcaggacagaaaaacttgagaattattttattcctgaattcaatctattctctagcaacttaattgacaaaagaagtaaagaatttctgacaaagcaaattgaatatgaaagaaacaatgagtttccagtttttgatgaattt

SEQ ID NO: 89 - DNA, 1137 bp, Homo sapiens
  Stimulator of Interferon Genes (STING)(H232 Allele)
atgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccatgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctct

SEQ ID NO: 90 - DNA, 972 bp, Salmonella typhimurium
  lipid A biosynthesis myristoyltransferase (msbB)
ttatttgatgggataaagatctttacgcttatacggctgaatctcgcctggcttgcgggttttgagcagcttcaggatccaggtgtactgttccggatgcgggccgacaaaaatttcgacctcttcgttcatccgtctggcgatagtgtggtcgtcagccgtgagcagatcgtccattggcgggcgaatctggatagtcaggcgatgcgttttaccattatacaccgggaaaagcggtatcacgcgtgcgcggcacactttcatcagccgaccaattgcaggcagcgtcgctttgtatgtcgcaaagaaatcaacgaattcactatgctccgggccgtgatcctggtccggcaggtagtaaccccagtagccctgacgaacagactgaataaagggtttaatcccgtcattacgcgcatgcaaacgtccgccgaaacgccgacgcactgtgttccagatatagtcaaaaaccggattaccctgattatgaaacatcgccgccattttttgcccctgagaggccatcagcatggctggaatgtcgacgccccagccatgcggtacgagaaaaatgactttttcgtcgttacgacgcatctcctcgataatctccagaccttcccagtcaacacgctgttgaatttttttcggaccgcgcatcgccaactcagccatcatcgccattgcctgtggcgcggtggcgaacatctcatcgacaatcgcttcgcgctcagcttcgctacgctgcggaaagcacaacgacagattaattagcgcccggcgacgagaactcttccccagccgtccggcaaaacgccccagcgtcgccagcaaagggtcgcggaatgatgccggtgttaatgcgatccccgccattgccgccgcgcccaaccaggcgccccaatactgtggatagcgaaaggatttttcgaattcagggatatactcactattattttttttggtttccat

SEQ ID NO: 91 - DNA, 1038 bp, Salmonella typhimurium
  Phosphoribosylaminoimidazole synthetase (purI)
ttattcaataaccacacgctgttcggaatcagaggctttgatgataccgattttccatgcgttttcacctttctcgtttagcagagcaagcgctttgtccgcttccggagcggagagcgcaatcaccatgccgacgccgcagttaaaggtacggtacatttcatgtcggctgacattaccggcggtttgcagccaggtaaagatggcgggccactgccaggacgactcattaattaccgcctgggtattctccggcagaacgcgcggaatattttcccaaaagcccccgccggtgaggtgggcgatagcgtgtacatcgacgttttcaatcagttccagaaccgattttacgtagatacgggtcggttcaagcagatgatcggccagcggcttcccttccagcagagtggtttgtgggtcgcagccgctaacgtcaataattttccgcaccagcgaatatccattcgagtgcgggccgctggagccgagtgcaatcagcacgtcgccttcggcaacccgggagccgtcgatgatttctgatttttcgactacgccgacgcagaaacccgccacatcgtaatcttcgccgtgatacatgcccggcatttccgccgtctcgccgccgaccagcgcgcagccggattgcaggcagccttcggcaataccgttgatcacgctggcggcggtatcgacatccagtttacccgtggcatagtaatcgaggaaaaacagcggttccgcgccctgaacgaccagatcgtttacgcacattgccaccagatcaataccgatagcgtcgtgacgctttaagtccatcgccaggcgaagtttggtacctacgccgtcagtgccggaaaccagtaccggttcacgatatttttgcggcaacgcgcacagcgcaccgaaaccgcccagaccgcccataacctccgggcggcgagttttcttcactacgcctttgattcgatcaaccagagcgttacccgcatcaatatcgacgccggcatctttatagctaagagaggtcttatcggtcac

SEQ ID NO: 92 - DNA, 426 bp, Homo sapiens
  Survivin (SVN)/BIRC5, isoform 1
atgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggat

SEQ ID NO: 93 - DNA, 285 bp, E. coli
  araBAD promoter (pBAD)
aagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcttacctgacgctttttatcgcaactctctactgtttctccat

SEQ ID NO: 94 - DNA, 459 bp, Homo sapiens
  Interleukin 2 (IL-2)
atgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgact

SEQ ID NO: 95 - DNA, 567 bp, Homo sapiens
  Interferon (IFN) alpha
atggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaa

SEQ ID NO: 96 - DNA, 729 bp, Homo sapiens
  CD48, isoform 1
atgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacc

SEQ ID NO: 97 - DNA, 1602 bp, Homo sapiens
  CD276/B7-H3, isoform 1
atgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcc

SEQ ID NO: 98 - DNA, 846 bp, Homo sapiens
  B7-H4/VTCN1
atggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaa

SEQ ID NO: 99 - DNA, 867 bp, Homo sapiens
  BTLA/CD272, isoform 1
atgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatagtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagt

SEQ ID NO: 100 - DNA, 276 bp, Homo sapiens
  Chemokine (C-C motif) ligand 4 (CCL4)
atgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaac

SEQ ID NO: 101 - DNA, 3537 bp, Homo sapiens
  CD103/ITGAE
atgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacatcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgcgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaat

SEQ ID NO: 102 - DNA, 1671 bp, Homo sapiens
  CD19, isoform 1
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccagg

SEQ ID NO: 103 - DNA, 579 bp, Homo sapiens
  Interleukin 18 (IL-18), isoform 1
atggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagac

SEQ ID NO: 104 - DNA, 1005 bp, Homo sapiens
  Fas ligand
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtc

SEQ ID NO: 105 - DNA, 1023 bp, Salmonella typhimurium
  firA/SSC
atgccttcaattcgactggctgacttagcagaacagttggatgcagaattacacggtgatggcgatatcgtcatcaccggcgttgcgtccatgcaatctgcaacaacaggccacattacgtttatggtgaatcctaagtaccgtgaacacttaggtttatgccaggcttctgcggttgtcatgacgcaggacgatcttccttttgctaagagtgcggcgctggtagttaaaaatccctacctgacctacgcgcgcatggcgcaaattttagatactacgccgcagcccgcgcagaatatcgcgccaagcgccgtgattgatgcgacggcaacgctgggtagcaatgtttcagtcggcgcgaatgcggtgattgaatctggcgtacaactgggcgataacgtggttatcggcgcaggctgtttcgtcggaaaaaatagcaaaatcggggcgggttcacgcttgtgggcgaacgtaacgatttaccacgacattcagatcggtgagaattgcctgatccagtccagtacggtgatcggcgcggacggttttggctacgctaacgatcgtggcaactgggtgaagatcccacaactgggccgggtcattattggcgatcgtgtcgagatcggcgcttgtaccaccattgaccgtggcgcgttggatgatactgttattggcaatggcgtgattattgataatcagtgccagattgcacataacgtcgtgattggcgacaatacggcagttgccggtggcgtcattatggcgggtagcctgaagattggccgttactgcatgattggcggcgccagcgtgatcaatgggcatatggaaatatgcgacaaagtcacggtaactggcatgggtatggtgatgcgtcccatcacggaaccgggcgtctactcctcaggcattccgctgcaacccaacaaagtatggcgtaaaactgctgcactggtgatgaacattgatgatatgagcaagcgtctcaaagcgattgagcgcaaggttaatcaacaagac

SEQ ID NO: 106 - DNA, 918 bp, E. coli
  htrB
atgacgaatctacccaagttctccaccgcactgcttcatccgcgttattggttaacctggttgggtattggcgtactttggttagtcgtgcaattgccctacccggttatctaccgcctcggttgtggattaggaaaactggcgttacgttttatgaaacgacgcgcaaaaattgtgcatcgcaacctggaactgtgcttcccggaaatgagcgaacaagaacgccgtaaaatggtggtgaagaatttcgaatccgttggcatgggcctgatggaaaccggcatggcgtggttctggccggaccgccgaatcgcccgctggacggaagtgatcggcatggaacacattcgtgacgtgcaggcgcaaaaacgcggcatcctgttagttggcatccattttctgacactggagctgggtgcgcggcagtttggtatgcaggaaccgggtattggcgtttatcgcccgaacgataatccactgattgactggctacaaacctggggccgtttgcgctcaaataaatcgatgctcgaccgcaaagatttaaaaggcatgattaaagccctgaaaaaaggcgaagtggtctggtacgcaccggatcatgattacggcccgcgctcaagcgttttcgtcccgttgtttgccgttgagcaggctgcgaccacgaccggaacctggatgctggcacggatgtccggcgcatgtctggtgcccttcgttccacgccgtaagccagatggcaaagggtatcaattgattatgctgccgccagagtgttctccgccactggatgatgccgaaactaccgccgcgtggatgaacaaagtggtcgaaaaatgcatcatgatggcaccagagcagtatatgtggttacaccgtcgctttaaaacacgcccggaaggcgttccttcacgctat

SEQ ID NO: 107 - DNA, 717 bp, Salmonella typhimurium
  ompR
atgcaagagaattataagattctggtggttgatgacgatatgcgtctgcgggcgctactggaacgttatctgaccgagcagggcttccaggttcgaagcgtcgctaacgctgagcagatggatcgtctgctgacccgtgaatctttccatctcatggtactggatttaatgctgccaggtgaagatggtctgtcgatttgtcgtcgcctgcgtagtcaaagtaatccaatgccgatcattatggtcacggcgaagggtgaagaggttgaccgtatcgtcgggctggaaatcggcgccgatgactacattcctaaaccgtttaacccgcgcgagctgttggcgcgtattcggcccgtgttacgtcgtcaggcaaacgaactgcccggcgcgccgtcgcaggaagaggccgttatcgcgttcggtaagtttaaactgaacctcggtacgcgcgagatgttccgtgaagatgaaccgatgccgctgaccagcggggagtttgcggtactgaaagcgttagtcagccatccgcgcgagccgctctctcgcgataagctgatgaatctggcccgtggccgcgagtattccgcgatggaacgctccatcgacgtccagatctcccgcctgcgccgtatggtggaagaagatccggcacatccgcgttatattcagaccgtctggggcctgggctacgtctttgtaccggacggttctaaagca

SEQ ID NO: 108 - DNA, 498 bp, Homo sapiens
  Inteferon (IFN) gamma
atgaaatatacaagttatatcttggcttttcagctctgcatcgttttgggttctcttggctgttactgccaggacccatatgtaaaagaagcagaaaaccttaagaaatattttaatgcaggtcattcagatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccag

SEQ ID NO: 109 - DNA, 699 bp, Homo sapiens
  Tumor necrosis factor (TNF) alpha
atgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctg

SEQ ID NO: 110 - DNA, 825 bp, Homo sapiens
  Atg5 long isoform
atgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagat

SEQ ID NO: 111 - DNA, 1350 bp, Homo sapiens
  Beclin1
atggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaa

SEQ ID NO: 112 - DNA, 2352 bp, Homo sapiens
  Toll-like receptor 2 (TLR2)
atgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaatgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcc

SEQ ID NO: 113 - DNA, 2517 bp, Homo sapiens
  TLR4, isoform 1
atgatgtctgcctcgcgcctggctgggactctgatcccagccatggccttcctctcctgcgtgagaccagaaagctgggagccctgcgtggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatc

SEQ ID NO: 114 - DNA, 2574 bp, Homo sapiens
  TLR5
atgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtcactgcttcatccttcccctttctggaacagctgcagctgctggagctcgggagccagtatacccccttgactattgacaaggaggccttcagaaacctgcccaaccttagaatcttggacctgggaagtagtaagatatacttcttgcatccagatgcttttcagggactgttccatctgtttgaacttagactgtatttctgtggtctctctgatgctgtattgaaagatggttatttcagaaatttaaaggctttaactcgcttggatctatccaaaaatcagattcgtagcctttaccttcatccttcatttgggaagttgaattccttaaagtccatagatttttcctccaaccaaatattccttgtatgtgaacatgagctcgagcccctacaagggaaaacgctctccttttttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctccgagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctcctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcaattggcttaatcacaccaatgtcactatagctgggcctcctgcagacatatattgtgtgtaccctgactcgttctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaaagaaaagaagaaagacaataacattccgttgcaaactgtagcaaccatctcc

SEQ ID NO: 115 - DNA, 2712 bp, Homo sapiens
  TLR3, isoform 1
atgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacat

SEQ ID NO: 116 - DNA, 3096 bp, Homo sapiens
  TLR9
atgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccgcgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaa

SEQ ID NO: 117 - DNA, 3147 bp, Homo sapiens
  TLR7
atggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtc

SEQ ID NO: 118 - DNA, 3177 bp, Homo sapiens
  TLR8, isoform 1
atgaaggagtcatctttgcaaaatagctcctgcagcctgggaaaggagactaaaaaggaaaacatgttccttcagtcgtcaatgctgacctgcattttcctgctaatatctggttcctgtgagttatgcgccgaagaaaatttttctagaagctatccttgtgatgagaaaaagcaaaatgactcagttattgcagagtgcagcaatcgtcgactacaggaagttccccaaacggtgggcaaatatgtgacagaactagacctgtctgataatttcatcacacacataacgaatgaatcatttcaagggctgcaaaatctcactaaaataaatctaaaccacaaccccaatgtacagcaccagaacggaaatcccggtatacaatcaaatggcttgaatatcacagacggggcattcctcaacctaaaaaacctaagggagttactgcttgaagacaaccagttaccccaaataccctctggtttgccagagtctttgacagaacttagtctaattcaaaacaatatatacaacataactaaagagggcatttcaagacttataaacttgaaaaatctctatttggcctggaactgctattttaacaaagtttgcgagaaaactaacatagaagatggagtatttgaaacgctgacaaatttggagttgctatcactatctttcaattctctttcacacgtgccacccaaactgccaagctccctacgcaaactttttctgagcaacacccagatcaaatacattagtgaagaagatttcaagggattgataaatttaacattactagatttaagcgggaactgtccgaggtgcttcaatgccccatttccatgcgtgccttgtgatggtggtgcttcaattaatatagatcgttttgcttttcaaaacttgacccaacttcgatacctaaacctctctagcacttccctcaggaagattaatgctgcctggtttaaaaatatgcctcatctgaaggtgctggatcttgaattcaactatttagtgggagaaatagcctctggggcatttttaacgatgctgccccgcttagaaatacttgacttgtcttttaactatataaaggggagttatccacagcatattaatatttccagaaacttctctaaacttttgtctctacgggcattgcatttaagaggttatgtgttccaggaactcagagaagatgatttccagcccctgatgcagcttccaaacttatcgactatcaacttgggtattaattttattaagcaaatcgatttcaaacttttccaaaatttctccaatctggaaattatttacttgtcagaaaacagaatatcaccgttggtaaaagatacccggcagagttatgcaaatagttcctcttttcaacgtcatatccggaaacgacgctcaacagattttgagtttgacccacattcgaacttttatcatttcacccgtcctttaataaagccacaatgtgctgcttatggaaaagccttagatttaagcctcaacagtattttcttcattgggccaaaccaatttgaaaatcttcctgacattgcctgtttaaatctgtctgcaaatagcaatgctcaagtgttaagtggaactgaattttcagccattcctcatgtcaaatatttggatttgacaaacaatagactagactttgataatgctagtgctcttactgaattgtccgacttggaagttctagatctcagctataattcacactatttcagaatagcaggcgtaacacatcatctagaatttattcaaaatttcacaaatctaaaagttttaaacttgagccacaacaacatttatactttaacagataagtataacctggaaagcaagtccctggtagaattagttttcagtggcaatcgccttgacattttgtggaatgatgatgacaacaggtatatctccattttcaaaggtctcaagaatctgacacgtctggatttatcccttaataggctgaagcacatcccaaatgaagcattccttaatttgccagcgagtctcactgaactacatataaatgataatatgttaaagttttttaactggacattactccagcagtttcctcgtctcgagttgcttgacttacgtggaaacaaactactctttttaactgatagcctatctgactttacatcttcccttcggacactgctgctgagtcataacaggatttcccacctaccctctggctttctttctgaagtcagtagtctgaagcacctcgatttaagttccaatctgctaaaaacaatcaacaaatccgcacttgaaactaagaccaccaccaaattatctatgttggaactacacggaaacccctttgaatgcacctgtgacattggagatttccgaagatggatggatgaacatctgaatgtcaaaattcccagactggtagatgtcatttgtgccagtcctggggatcaaagagggaagagtattgtgagtctggagctaacaacttgtgtttcagatgtcactgcagtgatattatttttcttcacgttctttatcaccaccatggttatgttggctgccctggctcaccatttgttttactgggatgtttggtttatatataatgtgtgtttagctaaggtaaaaggctacaggtctctttccacatcccaaactttctatgatgcttacatttcttatgacaccaaagatgcctctgttactgactgggtgataaatgagctgcgctaccaccttgaagagagccgagacaaaaacgttctcctttgtctagaggagagggattgggacccgggattggccatcatcgacaacctcatgcagagcatcaaccaaagcaagaaaacagtatttgttttaaccaaaaaatatgcaaaaagctggaactttaaaacagctttttacttggctttgcagaggctaatggatgagaacatggatgtgattatatttatcctgctggagccagtgttacagcattctcagtatttgaggctacggcagcggatctgtaagagctccatcctccagtggcctgacaacccgaaggcagaaggcttgttttggcaaactctgagaaatgtggtcttgactgaaaatgattcacggtataacaatatgtatgtcgattccattaagcaatac

SEQ ID NO: 119 - DNA, 636 bp, Homo sapiens
  Interleukin 6 (IL-6)
atgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatg

SEQ ID NO: 120 - DNA, 951 bp, Homo sapiens
  MyD88, isoform 1
atgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattgaggaggattgccaaaagtatatcttgaagcagcagcaggaggaggctgagaagcctttacaggtggccgctgtagacagcagtgtcccacggacagcagagctggcgggcatcaccacacttgatgaccccctggggcatatgcctgagcgtttcgatgccttcatctgctattgccccagcgacatccagtttgtgcaggagatgatccggcaactggaacagacaaactatcgactgaagttgtgtgtgtctgaccgcgatgtcctgcctggcacctgtgtctggtctattgctagtgagctcatcgaaaagaggttggctagaaggccacggggtgggtgccgccggatggtggtggttgtctctgatgattacctgcagagcaaggaatgtgacttccagaccaaatttgcactcagcctctctccaggtgcccatcagaagcgactgatccccatcaagtacaaggcaatgaagaaagagttccccagcatcctgaggttcatcactgtctgcgactacaccaacccctgcaccaaatcttggttctggactcgccttgccaaggccttgtccctgccc

SEQ ID NO: 121 - DNA, 807 bp, Homo sapiens
  Interleukin 1-beta (IL-1beta)
atggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcc

SEQ ID NO: 122 - DNA, 3075 bp, Homo sapiens
  MDA5/IFIH1, isoform 1
atgtcgaatgggtattccacagacgagaatttccgctatctcatctcgtgcttcagggccagggtgaaaatgtacatccaggtggagcctgtgctggactacctgacctttctgcctgcagaggtgaaggagcagattcagaggacagtcgccacctccgggaacatgcaggcagttgaactgctgctgagcaccttggagaagggagtctggcaccttggttggactcgggaattcgtggaggccctccggagaaccggcagccctctggccgcccgctacatgaaccctgagctcacggacttgccctctccatcgtttgagaacgctcatgatgaatatctccaactgctgaacctccttcagcccactctggtggacaagcttctagttagagacgtcttggataagtgcatggaggaggaactgttgacaattgaagacagaaaccggattgctgctgcagaaaacaatggaaatgaatcaggtgtaagagagctactaaaaaggattgtgcagaaagaaaactggttctctgcatttctgaatgttcttcgtcaaacaggaaacaatgaacttgtccaagagttaacaggctctgattgctcagaaagcaatgcagagattgagaatttatcacaagttgatggtcctcaagtggaagagcaacttctttcaaccacagttcagccaaatctggagaaggaggtctggggcatggagaataactcatcagaatcatcttttgcagattcttctgtagtttcagaatcagacacaagtttggcagaaggaagtgtcagctgcttagatgaaagtcttggacataacagcaacatgggcagtgattcaggcaccatgggaagtgattcagatgaagagaatgtggcagcaagagcatccccggagccagaactccagctcaggccttaccaaatggaagttgcccagccagccttggaagggaagaatatcatcatctgcctccctacagggagtggaaaaaccagagtggctgtttacattgccaaggatcacttagacaagaagaaaaaagcatctgagcctggaaaagttatagttcttgtcaataaggtactgctagttgaacagctcttccgcaaggagttccaaccatttttgaagaaatggtatcgtgttattggattaagtggtgatacccaactgaaaatatcatttccagaagttgtcaagtcctgtgatattattatcagtacagctcaaatccttgaaaactccctcttaaacttggaaaatggagaagatgctggtgttcaattgtcagacttttccctcattatcattgatgaatgtcatcacaccaacaaagaagcagtgtataataacatcatgaggcattatttgatgcagaagttgaaaaacaatagactcaagaaagaaaacaaaccagtgattccccttcctcagatactgggactaacagcttcacctggtgttggaggggccacgaagcaagccaaagctgaagaacacattttaaaactatgtgccaatcttgatgcatttactattaaaactgttaaagaaaaccttgatcaactgaaaaaccaaatacaggagccatgcaagaagtttgccattgcagatgcaaccagagaagatccatttaaagagaaacttctagaaataatgacaaggattcaaacttattgtcaaatgagtccaatgtcagattttggaactcaaccctatgaacaatgggccattcaaatggaaaaaaaagctgcaaaagaaggaaatcgcaaagaacgtgtttgtgcagaacatttgaggaagtacaatgaggccctacaaattaatgacacaattcgaatgatagatgcgtatactcatcttgaaactttctataatgaagagaaagataagaagtttgcagtcatagaagatgatagtgatgagggtggtgatgatgagtattgtgatggtgatgaagatgaggatgatttaaagaaacctttgaaactggatgaaacagatagatttctcatgactttattttttgaaaacaataaaatgttgaaaaggctggctgaaaacccagaatatgaaaatgaaaagctgaccaaattaagaaataccataatggagcaatatactaggactgaggaatcagcacgaggaataatctttacaaaaacacgacagagtgcatatgcgctttcccagtggattactgaaaatgaaaaatttgctgaagtaggagtcaaagcccaccatctgattggagctggacacagcagtgagttcaaacccatgacacagaatgaacaaaaagaagtcattagtaaatttcgcactggaaaaataaatctgcttatcgctaccacagtggcagaagaaggtctggatattaaagaatgtaacattgttatccgttatggtctcgtcaccaatgaaatagccatggtccaggcccgtggtcgagccagagctgatgagagcacctacgtcctggttgctcacagtggttcaggagttatcgaacatgagacagttaatgatttccgagagaagatgatgtataaagctatacattgtgttcaaaatatgaaaccagaggagtatgctcataagattttggaattacagatgcaaagtataatggaaaagaaaatgaaaaccaagagaaatattgccaagcattacaagaataacccatcactaataactttcctttgcaaaaactgcagtgtgctagcctgttctggggaagatatccatgtaattgagaaaatgcatcacgtcaatatgaccccagaattcaaggaactttacattgtaagagaaaacaaagcactgcaaaagaagtgtgccgactatcaaataaatggtgaaatcatctgcaaatgtggccaggcttggggaacaatgatggtgcacaaaggcttagatttgccttgtctcaaaataaggaattttgtagtggttttcaaaaataattcaacaaagaaacaatacaaaaagtgggtagaattacctatcacatttcccaatcttgactattcagaatgctgtttatttagtgatgaggat

SEQ ID NO: 123 - DNA, 1620 bp, Homo sapiens
  IPS-1/MAVS, isoform 1
atgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcac

SEQ ID NO: 124 - DNA, 2775 bp, Homo sapiens
  RIG-1/DDX58, isoform 1
atgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaa

SEQ ID NO: 125 - DNA, 1494 bp, Homo sapiens
  IRF5, transcript variant 2
atgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagaggatgtcaagtggccgcccactctgcagccgcccactctgcggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaa

SEQ ID NO: 126 - DNA, 1284 bp, Homo sapiens
  IRF3, isoform 1
accatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtagatctgattaccttcacggaaggaagcggacgctcaccacgctatgccctctggttctgtgtgggggagtcatggccccaggaccagccgtggaccaagaggctcgtgatggtcaaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagagc

SEQ ID NO: 127 - DNA, 1275 bp, Homo sapiens
  TANK
atggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagact

SEQ ID NO: 128 - DNA, 2136 bp, Homo sapiens
  TRIF/TICAM1
atggcctgcacaggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaa

SEQ ID NO: 129 - DNA, 381 bp, Homo sapiens
  Batf3
atgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccga

SEQ ID NO: 130 - DNA, 459 bp, Homo sapiens
  IL-4, isoform 1
atgggtctcacctcccaactgcttccccctctgttcttcctgctagcatgtgccggcaactttgtccacggacacaagtgcgatatcaccttacaggagatcatcaaaactttgaacagcctcacagagcagaagactctgtgcaccgagttgaccgtaacagacatctttgctgcctccaagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttgaattcctgtcctgtgaaggaagccaaccagagtacgttggaaaacttcttggaaaggctaaagacgatcatgagagagaaatattcaaagtgttcgagc

SEQ ID NO: 131 - DNA, 534 bp, Homo sapiens
  IL-10
atgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaac

SEQ ID NO: 132 - DNA, 759 bp, Homo sapiens
  IL-12 alpha
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcc

SEQ ID NO: 133 - DNA, 986 bp, Homo sapiens
  IL-12 beta
agatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagt

SEQ ID NO: 134 - DNA, 276 bp, Homo sapiens
  MIP-1 alpha/ CCL3
atgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctggagctgagtgcc

SEQ ID NO: 135 - DNA, 1530 bp, Homo sapiens
  CD39/ENTPD1, isoform 1
atggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggta

SEQ ID NO: 136 - DNA, 1722 bp, Homo sapiens
  CD73/NT5E, isoform 1
atgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaa

SEQ ID NO: 137 - DNA, 297 bp, Homo sapiens
  IL-8 (CXCL8)
atgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattca

SEQ ID NO: 138 - DNA, 1596 bp, Homo sapiens
  ICAM1
atggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccc

SEQ ID NO: 139 - DNA, 1488 bp, Homo sapiens
  angiopoietin 2, isoform 1
atgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttc

SEQ ID NO: 140 - DNA, 2766 bp, Homo sapiens
  NLRP3, isoform 2
atgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttgg

SEQ ID NO: 141 - DNA, 831 bp, Homo sapiens
  CD40, isoform 1
atggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacag

SEQ ID NO: 142 - DNA, 783 bp, Homo sapiens
  CD40 ligand (CD40L)
atgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactc

SEQ ID NO: 143 - DNA, 579 bp, Homo sapiens
  CD-70 antigen, isoform 1
atgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccc

SEQ ID NO: 144 - DNA, 765 bp, Homo sapiens
  CD137 (4-1BB, TNFRSF9)
atgggaaacagctgttacaacatagtagccactctgttgctggtcctcaactttgagaggacaagatcattgcaggatccttgtagtaactgcccagctggtacattctgtgataataacaggaatcagatttgcagtccctgtcctccaaatagtttctccagcgcaggtggacaaaggacctgtgacatatgcaggcagtgtaaaggtgttttcaggaccaggaaggagtgttcctccaccagcaatgcagagtgtgactgcactccagggtttcactgcctgggggcaggatgcagcatgtgtgaacaggattgtaaacaaggtcaagaactgacaaaaaaaggttgtaaagactgttgctttgggacatttaacgatcagaaacgtggcatctgtcgaccctggacaaactgttctttggatggaaagtctgtgcttgtgaatgggacgaaggagagggacgtggtctgtggaccatctccagccgacctctctccgggagcatcctctgtgaccccgcctgcccctgcgagagagccaggacactctccgcagatcatctccttctttcttgcgctgacgtcgactgcgttgctcttcctgctgttcttcctcacgctccgtttctctgttgttaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 145 - DNA, 807 bp, Homo sapiens
  CD200, isoform 1
atggagaggctggtgatcaggatgcccttctctcatctgtctacctacagcctggtttgggtcatggcagcagtggtgctgtgcacagcacaagtgcaagtggtgacccaggatgaaagagagcagctgtacacacctgcttccttaaaatgctctctgcaaaatgcccaggaagccctcattgtgacatggcagaaaaagaaagctgtaagcccagaaaacatggtcaccttcagcgagaaccatggggtggtgatccagcctgcctataaggacaagataaacattacccagctgggactccaaaactcaaccatcaccttctggaatatcaccctggaggatgaagggtgttacatgtgtctcttcaatacctttggttttgggaagatctcaggaacggcctgcctcaccgtctatgtacagcccatagtatcccttcactacaaattctctgaagaccacctaaatatcacttgctctgccactgcccgcccagcccccatggtcttctggaaggtccctcggtcagggattgaaaatagtacagtgactctgtctcacccaaatgggaccacgtctgttaccagcatcctccatatcaaagaccctaagaatcaggtggggaaggaggtgatctgccaggtgctgcacctggggactgtgaccgactttaagcaaaccgtcaacaaaggctattggttttcagttccgctattgctaagcattgtttccctggtaattcttctcgtcctaatctcaatcttactgtactggaaacgtcaccggaatcaggaccgagagccc

SEQ ID NO: 146 - DNA, 1236 bp, Homo sapiens
  A2aR (ADORA2A)
atgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcc

SEQ ID NO: 147 - DNA, 723 bp, Homo sapiens
  GITR/TNFRSF18, isoform 1
atggcacagcacggggcgatgggcgcgtttcgggccctgtgcggcctggcgctgctgtgcgcgctcagcctgggtcagcgccccaccgggggtcccgggtgcggccctgggcgcctcctgcttgggacgggaacggacgcgcgctgctgccgggttcacacgacgcgctgctgccgcgattacccgggcgaggagtgctgttccgagtgggactgcatgtgtgtccagcctgaattccactgcggagacccttgctgcacgacctgccggcaccacccttgtcccccaggccagggggtacagtcccaggggaaattcagttttggcttccagtgtatcgactgtgcctcggggaccttctccgggggccacgaaggccactgcaaaccttggacagactgcacccagttcgggtttctcactgtgttccctgggaacaagacccacaacgctgtgtgcgtcccagggtccccgccggcagagccgcttgggtggctgaccgtcgtcctcctggccgtggccgcctgcgtcctcctcctgacctcggcccagcttggactgcacatctggcagctgaggagtcagtgcatgtggccccgagagacccagctgctgctggaggtgccgccgtcgaccgaagacgccagaagctgccagttccccgaggaagagcggggcgagcgatcggcagaggagaaggggcggctgggagacctgtgggtg

SEQ ID NO: 148 - DNA, 1362 bp, Homo sapiens
  B7-H6 (NCR3LG1)
atgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacag

SEQ ID NO: 149 - DNA, 597 bp, Homo sapiens
  ICOS, isoform 1
atgaagtcaggcctctggtatttctttctcttctgcttgcgcattaaagttttaacaggagaaatcaatggttctgccaattatgagatgtttatatttcacaacggaggtgtacaaattttatgcaaatatcctgacattgtccagcaatttaaaatgcagttgctgaaaggggggcaaatactctgcgatctcactaagacaaaaggaagtggaaacacagtgtccattaagagtctgaaattctgccattctcagttatccaacaacagtgtctctttttttctatacaacttggaccattctcatgccaactattacttctgcaacctatcaatttttgatcctcctccttttaaagtaactcttacaggaggatatttgcatatttatgaatcacaactttgttgccagctgaagttctggttacccataggatgtgcagcctttgttgtagtctgcattttgggatgcatacttatttgttggcttacaaaaaagaagtattcatccagtgtgcacgaccctaacggtgaatacatgttcatgagagcagtgaacacagccaaaaaatctagactcacagatgtgacccta

SEQ ID NO: 150 - DNA, 906 bp, Homo sapiens
  ICOS ligand, isoform 1
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtt

SEQ ID NO: 151 - DNA, 1344 bp, Homo sapiens
  gp49B/LILRB4, isoform 1
atgatccccaccttcacggctctgctctgcctcgggctgagtctgggccccaggacccacatgcaggcagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggagcctacagtaaacccaccctttcagccctgccgagtcctcttgtgacctcaggaaagagcgtgaccctgctgtgtcagtcacggagcccaatggacacttttcttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggatccttggagggtcccaggccctcacccacaaggtccgtctcaacagctgcaggccctgaggaccagcccctcatgcctacagggtcagtcccccacagtggtctgagaaggcactgggaggtactgatcggggtcttggtggtctccatcctgcttctctccctcctcctcttcctcctcctccaacactggcgtcagggaaaacacaggacattggcccagagacaggctgatttccaacgtcctccaggggctgccgagccagagcccaaggacgggggcctacagaggaggtccagcccagctgctgacgtccagggagaaaacttctgtgctgccgtgaagaacacacagcctgaggacggggtggaaatggacactcggcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggctgctgcatctgaagccccccaggatgtgacctacgcccggctgcacagctttaccctcagacagaaggcaactgagcctcctccatcccaggaaggggcctctccagctgagcccagtgtctatgccactctggccatccac

SEQ ID NO: 152 - DNA, 1896 bp, Homo sapiens
  PIR-B/LILRB3, isoform 1
atgacgcccgccctcacagccctgctctgccttgggctgagtctgggccccaggacccgcatgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggattctacaacaaacccaccctctcagccctgcccagccctgtggtggcctcaggggggaatatgaccctccgatgtggctcacagaagggatatcaccattttgttctgatgaaggaaggagaacaccagctcccccggaccctggactcacagcagctccacagtggggggttccaggccctgttccctgtgggccccgtgacccccagccacaggtggaggttcacatgctattactattatacaaacaccccctgggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagccgctcctacgggggccagtacaggtgctatggtgcacacaacctctcctccgagtggtcggcccccagtgaccccctggacatcctgatcacaggacagatctatgacaccgtctccctgtcagcacagccgggccccacagtggcctcaggagagaacatgaccctgctgtgtcagtcacgggggtattttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcacgcagctccaacccccacctgctgtctttccccagtgagcccctggaactcatggtctcaggacactctggaggctccagcctcccacccacagggccgccctccacacctggtctgggaagatacctggaggttttgattggggtctcggtggccttcgtcctgctgctcttcctcctcctcttcctcctcctcctccgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgctgtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccac

SEQ ID NO: 153 - DNA, 1014 bp, Homo sapiens
  HLA-G alpha chain
atggtggtcatggcgccccgaaccctcttcctgctgctctcgggggccctgaccctgaccgagacctgggcgggctcccactccatgaggtatttcagcgccgccgtgtcccggcccggccgcggggagccccgcttcatcgccatgggctacgtggacgacacgcagttcgtgcggttcgacagcgactcggcgtgtccgaggatggagccgcgggcgccgtgggtggagcaggaggggccggagtattgggaagaggagacacggaacaccaaggcccacgcacagactgacagaatgaacctgcagaccctgcgcggctactacaaccagagcgaggccagttctcacaccctccagtggatgattggctgcgacctggggtccgacggacgcctcctccgcgggtatgaacagtatgcctacgatggcaaggattacctcgccctgaacgaggacctgcgctcctggaccgcagcggacactgcggctcagatctccaagcgcaagtgtgaggcggccaatgtggctgaacaaaggagagcctacctggagggcacgtgcgtggagtggctccacagatacctggagaacgggaaggagatgctgcagcgcgcggacccccccaagacacacgtgacccaccaccctgtctttgactatgaggccaccctgaggtgctgggccctgggcttctaccctgcggagatcatactgacctggcagcgggatggggaggaccagacccaggacgtggagctcgtggagaccaggcctgcaggggatggaaccttccagaagtgggcagctgtggtggtgccttctggagaggagcagagatacacgtgccatgtgcagcatgaggggctgccggagcccctcatgctgagatggaagcagtcttccctgcccaccatccccatcatgggtatcgttgctggcctggttgtccttgcagctgtagtcactggagctgcggtcgctgctgtgctgtggagaaagaagagctcagat

SEQ ID NO: 154 - DNA, 1092 bp, Homo sapiens
  TIM1/HAVCR1
atgcatcctcaagtggtcatcttaagcctcatcctacatctggcagattctgtagctggttctgtaaaggttggtggagaggcaggtccatctgtcacactaccctgccactacagtggagctgtcacatccatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaatgacgactgttccaacgacaactgttccaacaacaatgagcattccaacgacaacgactgttctgacgacaatgactgtttcaacgacaacgagcgttccaacgacaacgagcattccaacaacaacaagtgttccagtgacaacaactgtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggac

SEQ ID NO: 155 - DNA, 1134 bp, Homo sapiens
  TIM4/TIMD4, isoform 1
atgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctc

SEQ ID NO: 156 - DNA, 831 bp, Homo sapiens
  OX-40/CD134/TNFRSF4
atgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatc

SEQ ID NO: 157 - DNA, 549 bp, Homo sapiens
  OX-40L/CD252/TNFSF4, isoform 1
atggaaagggtccaacccctggaagagaatgtgggaaatgcagccaggccaagattcgagaggaacaagctattgctggtggcctctgtaattcagggactggggctgctcctgtgcttcacctacatctgcctgcacttctctgctcttcaggtatcacatcggtatcctcgaattcaaagtatcaaagtacaatttaccgaatataagaaggagaaaggtttcatcctcacttcccaaaaggaggatgaaatcatgaaggtgcagaacaactcagtcatcatcaactgtgatgggttttatctcatctccctgaagggctacttctcccaggaagtcaacattagccttcattaccagaaggatgaggagcccctcttccaactgaagaaggtcaggtctgtcaactccttgatggtggcctctctgacttacaaagacaaagtctacttgaatgtgaccactgacaatacctccctggatgacttccatgtgaatggcggagaactgattcttatccatcaaaatcctggtgaattctgtgtcctt

SEQ ID NO: 158 - DNA, 1950 bp, Homo sapiens
  ILT-2/LILRB1, isoform 1
atgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccac

SEQ ID NO: 159 - DNA, 1794 bp, Homo sapiens
  ILT-4/LILRB2, isoform 1
atgacccccatcgtcacagtcctgatctgtctcgggctgagtctgggccccaggacccgcgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccac

SEQ ID NO: 160 - DNA, 717 bp, Homo sapiens
  BCL-2 isoform alpha
atggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaag

SEQ ID NO: 161 - DNA, 4050 bp, Homo sapiens
  MDR1/ABCB1, isoform 1
atgagtgtcaacttgcaaggggaccagagaggtgcaacggaagccagaacattcctcctggaaattcaacctgtttcgcagtttctcgaggaatcagcattcagtcaatccgggccgggagcagtcatctgtggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccag

SEQ ID NO: 162 - DNA, 990 bp, Homo sapiens
  Arginase1, isoform 1
atgagcgccaagtccagaaccatagggattattggagctcctttctcaaagggacagccacgaggaggggtggaagaaggccctacagtattgagaaaggctggtctgcttgagaaacttaaagaacaagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaagattcccgatgtgccaggattctcctgggtgactccctgtatatctgccaaggatattgtgtatattggcttgagagacgtggaccctggggaacactacattttgaaaactctaggcattaaatacttttcaatgactgaagtggacagactaggaattggcaaggtgatggaagaaacactcagctatctactaggaagaaagaaaaggccaattcatctaagttttgatgttgacggactggacccatctttcacaccagctactggcacaccagtcgtgggaggtctgacatacagagaaggtctctacatcacagaagaaatctacaaaacagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaag

SEQ ID NO: 163 - DNA, 3459 bp, Homo sapiens
  nitric oxide synthase, inducible (iNOS/NOS2), isoform 1
atggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgctccatagtttccagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggtatcctggagcgagtggtggatggccccacaccccaccagacagtgcgcctggaggccctggatgagagtggcagctactgggtcagtgacaagaggctgcccccctgctcactcagccaggccctcacctacttcctggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacagagatccacctgactgtggccgtggtcacctaccacacccgagatggccagggtcccctgcaccacggcgtctgcagcacatggctcaacagcctgaagccccaagacccagtgccctgctttgtgcggaatgccagcggcttccacctccccgaggatccctcccatccttgcatcctcatcgggcctggcacaggcatcgcgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatctttggtgctgtatttccttacgaggcgaagaaggacagggtggcggtgcagcccagcagcctggagatgtcagcgctc

SEQ ID NO: 164 - DNA, 3765 bp, Homo sapiens
  Her2
atggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtg

SEQ ID NO: 165 - DNA, 567 bp, Homo sapiens
  KRAS
atgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatg

SEQ ID NO: 166 - DNA, 1809 bp, Homo sapiens
  PLK1
atgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcc

SEQ ID NO: 167 - DNA, 876 bp, Salmonella typhimurium
  dapA, strain LT2
atgttcacgggaagtattgtcgcgcttgttacgccgatggatgagaaaggtaacgtcagtaggtcttgcctgaaaaaactcattgattatcatgtcgccaacggtacctcggcgattgtttcggttggcactaccggcgagtctgccacgctaagccatgatgaacatggcgatgtcgtgatgatgacgctggaactggctgacggacgtattccggttatcgccggcacgggcgcaaacgcgaccgcggaagcgattagcctgacgcagcgttttaacgatagcggtattgtaggctgcctgacggtaacgccgtactacaatcgccccacgcaggaaggtttgttccagcatttcaaagccatcgcggaacacactgacttgccgcaaattctgtataatgtgccgtcccgtaccggttgcgatatgttgccggaaaccgtgggtcgtctggcggaaataaaaaatattatcgctatcaaagaggcgacagggaacttaacccgcgttcaccagatcaaagagctggtttcagacgattttattctgcttagcggcgatgacgcgtctgcgctggactttatgcaactgggtggtcatggcgtgatttccgttacggctaacgtagcggcgcgcgagatggctgacatgtgcaaactggcggcggaagggcaatttgccgaggcgcgcgctatcaaccagcgtctgatgccgttacacaacaaactatttgtcgaacccaatcctatcccggtgaaatgggcatgtaaggcattgggtcttgtggcgaccgacacgctgcgcctgccaatgacgcctatcacggaccatggtcgtgacatcgtcaaagcagcgcttcagcatgctggcctgctg

SEQ ID NO: 168 - DNA, 819 bp, Salmonella typhimurium
  dapB, strain LT2
atgcatgaagcacaaatccgcgtcgccattgccggcgccggtggccgcatgggacggcagttaatccaggccgccatggcgatggaaggtgttcagctgggtgccgcgctggagcgcgaaggctcttccttgctgggcagcgatgctggcgaactggcaggggcgggaaagtccggcgtgatcgttcaaagcagccttgaggcggtaaaagatgattttgacgttttcatcgattttacccgtccggaaggcacgttgacgcatctggcgttttgccgccagcatggtaaagggatggtgattggtactaccggctttgacgacgccggtaaacaagccattcgcgaggcgtcacaagagattgcgatcgttttcgccgcaaactttagcgtcggcgttaacgtcatgctcaagctgctggagaaagccgcgaaggtaatgggcgactatagcgatattgaaattattgaagcgcaccaccgccataaagtggatgcaccgtcgggtacggcgctggcaatgggcgaggcaatcgccggggcgctggataaaaatctgaaggactgcgcggtctactcgcgtgaaggttataccggcgagcgcgtagcgggcacgattggctttgcgaccgttcgggcgggcgacatcgtcggcgaacataccgcgatgtttgccgatattggcgagcgcgtagagattacgcataaagcttccagccgcatgacgtttgcaaatggcgcgttgcgatcggcgttatggctaaaaacgaagaaaaatgggctatttgacatgcgggatgtgctggggctggatgtatta

SEQ ID NO: 169 - DNA, 876 bp, E. coli
  dapA
atgttcacgggaagtattgtcgcgattgttactccgatggatgaaaaaggtaatgtctgtcgggctagcttgaaaaaactgattgattatcatgtcgccagcggtacttcggcgatcgtttctgttggcaccactggcgagtccgctaccttaaatcatgacgaacatgctgatgtggtgatgatgacgctggatctggctgatgggcgcattccggtaattgccgggaccggcgctaacgctactgcggaagccattagcctgacgcagcgcttcaatgacagtggtatcgtcggctgcctgacggtaaccccttactacaatcgtccgtcgcaagaaggtttgtatcagcatttcaaagccatcgctgagcatactgacctgccgcaaattctgtataatgtgccgtcccgtactggctgcgatctgctcccggaaacggtgggccgtctggcgaaagtaaaaaatattatcggaatcaaagaggcaacagggaacttaacgcgtgtaaaccagatcaaagagctggtttcagatgattttgttctgctgagcggcgatgatgcgagcgcgctggacttcatgcaattgggcggtcatggggttatttccgttacgactaacgtcgcagcgcgtgatatggcccagatgtgcaaactggcagcagaagaacattttgccgaggcacgcgttattaatcagcgtctgatgccattacacaacaaactatttgtcgaacccaatccaatcccggtgaaatgggcatgtaaggaactgggtcttgtggcgaccgatacgctgcgcctgccaatgacaccaatcaccgacagtggtcgtgagacggtcagagcggcgcttaagcatgccggtttgctg

SEQ ID NO: 170 - DNA, 819 bp, E. coli
  dapB
atgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgcggccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttg

SEQ ID NO: 171 - DNA, 1218 bp, E. coli
  dapC
atggcaattgaacaaacagcaattacacgcgcgactttcgatgaagtgatcctgccgatttatgctccggcagagtttattccggtaaaaggtcagggcagccgaatctgggatcagcaaggcaaggagtatgtcgatttcgcgggtggcattgcagttacggcgttgggccattgccatcctgcgctggtgaacgcgttaaaaacccagggcgaaactctgtggcatatcagtaacgttttcaccaatgaaccggcgctgcgtcttgggcgtaaactgattgaggcaacgtttgccgaacgcgtggtgtttatgaactccggcacggaagctaacgaaaccgcctttaaactggcacgccattacgcctgtgtgcgtcatagcccgttcaaaaccaaaattattgccttccataacgcttttcatggtcgctcgctgtttaccgtttcggtgggtgggcagccaaaatattccgacggctttgggccgaaaccggcagacatcatccacgttccctttaacgatctccatgcagtgaaagcggtgatggatgatcacacctgtgcggtggtggttgagccgatccagggcgagggcggtgtgacggcagcgacgccagagtttttgcagggcttgcgcgagctgtgcgatcaacatcaggcattattggtgtttgatgaagtgcagtgcgggatggggcggaccggcgatttgtttgcttacatgcactacgcgttagcgccggatattctgacctctgcgaaagcgttaggcggcggcttcccgattagcgccatgctgaccacggcggaaattgcttctgcgtttcatcctggttctcacggttccacctacggcggtaatcctctggcctgtgcagtagcgggggcggcgtttgatatcatcaatacccctgaagtgctggaaggcattcaggcgaaacgccagcgttttgttgaccatctgcagaagatcgatcagcagtacgatgtatttagcgatattcgcggtatggggctgttgattggcgcagagctgaaaccacagtacaaaggtcgggcgcgtgatttcctgtatgcgggcgcagaggctggcgtaatggtgctgaatgccggaccggatgtgatgcgttttgcaccgtcgctggtggtggaagatgcggatatcgatgaagggatgcaacgtttcgcccacgcggtggcgaaggtggttggggcg

SEQ ID NO: 172 - DNA, 822 bp, E. coli
  dapD
atgcagcagttacagaacattattgaaaccgcttttgaacgccgtgccgagatcacgccagccaatgcagacaccgttacccgcgaagcggataatcaggtgatcgccctgctggattccggcgcactgcgtgtagcggaaaaaattgacggtcagtgggtgacgcatcagtggttgaaaaaagcggtgctgctctctttccgtattaatgataatcaggtgatcgaaggggcagaaagccgctacttcgacaaagtgccgatgaaattcgccgactacgacgaagcacgtttccagaaagaaggcttccgcgttgtgccaccagcggcggtacgtcagggtgcgtttattgcccgtaacaccgtgctgatgccgtcttacgtcaacatcggcgcatatgttgatgaaggcaccatggttgatacctgggcgaccgtcggttcttgtgcgcagattggtaaaaacgttcacctttccggtggcgtgcgcatcggcggcgtgctggaaccgctgcaggctaacccaaccatgattgaagataattgcttcatcggcgcgcgctctgaactggttgaaggggtgattgtcgaagaaggttccgtcatttccatgggcgtatacattggtcagagcacccgtatttacgaccgtgaaaccggcgaaatccactacggtcgcgttccggcggggtctgtggttgtttcaggtaatctgccgtcaaaagatggcaaatacagcctctactgtgcggttatcgttaagaaagttgacgcgaaaactcgcggcaaagtcggcattaacgaactgctgcgtaccatcgac

SEQ ID NO: 173 - DNA, 1125 bp, E. coli
  dapE
atgtcgtgcccggttattgagctgacacaacagcttattcgccgcccttccctgagtcctgatgatgcaggatgccaggctttgttgattgaacgtttgcaggcgatcggttttaccgttgaacgcatggactttgccgatacgcagaatttttgggcatggcgtgggcagggtgaaacgttagcctttgccgggcataccgacgtggtgccgcctggcgacgccgatcgttggatcaatcccccgtttgaacccaccattcgtgacggcatgttattcgggcgcggtgcggcagatatgaaaggctcgctggcggcgatggtggtggcggcagaacgttttgtcgcacaacatcccaaccatacggggcgactggcatttctgatcacctctgatgaagaagccagtgcccacaacggtacggtaaaagtcgtcgaagcgttaatggcacgtaatgagcgtctcgattactgcctggttggcgaaccgtcgagtatcgaagtggtaggtgatgtggtgaaaaatggtcgtcgcggatcattaacctgcaaccttaccattcatggcgttcaggggcatgttgcctacccacatctggctgacaatccggtacatcgcgcagcacctttccttaatgaattagtggctattgagtgggatcagggcaatgaattcttcccggcgaccagtatgcagattgccaatattcaggcgggaacgggcagtaacaacgttattccgggtgaactgtttgtgcagtttaacttccgcttcagcaccgaactgactgatgagatgatcaaagcgcaggtgcttgccctgcttgaaaaacatcaactgcgctatacggtggattggtggctttccgggcagccatttttgaccgcgcgcggtaaactggtggatgcggtcgttaacgcggttgagcactataatgaaattaaaccgcagctactgaccacaggcggaacgtccgacgggcgctttattgcccgcatgggggcgcaggtggtggaactcgggccggtcaatgccactattcataaaattaatgaatgtgtgaacgctgccgacctgcagctacttgcccgtatgtatcaacgtatcatggaacagctcgtcgcc

SEQ ID NO: 174 - DNA, 1179 bp, Homo sapiens
  p53
atggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcatgtttgtgcctgtcctgggagagaccggcgcacagaggaagagaatctccgcaagaaaggggagcctcaccacgagctgcccccagggagcactaagcgagcactgtccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagac

SEQ ID NO: 175 - DNA, 1470 bp, Homo sapiens
  ERBA
atggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccc

SEQ ID NO: 176 - DNA, 1317 bp, Homo sapiens
  myc
atgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcg

SEQ ID NO: 177 - DNA, 2283 bp, Homo sapiens
  MYB
atggcccgaagaccccggcacagcatatatagcagtgacgaggatgatgaggactttgagatgtgtgaccatgactatgatgggctgcttcccaagtctggaaagcgtcacttggggaaaacaaggtggacccgggaagaggatgaaaaactgaagaagctggtggaacagaatggaacagatgactggaaagttattgccaattatctcccgaatcgaacagatgtgcagtgccagcaccgatggcagaaagtactaaaccctgagctcatcaagggtccttggaccaaagaagaagatcagagagtgatagagcttgtacagaaatacggtccgaaacgttggtctgttattgccaagcacttaaaggggagaattggaaaacaatgtagggagaggtggcataaccacttgaatccagaagttaagaaaacctcctggacagaagaggaagacagaattatttaccaggcacacaagagactggggaacagatgggcagaaatcgcaaagctactgcctggacgaactgataatgctatcaagaaccactggaattctacaatgcgtcggaaggtcgaacaggaaggttatctgcaggagtcttcaaaagccagccagccagcagtggccacaagcttccagaagaacagtcatttgatgggttttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagacactataatgatgaagaccctgagaaggaaaagcgaataaaggaattagaattgctcctaatgtcaaccgagaatgagctaaaaggacagcaggtgctaccaacacagaaccacacatgcagctaccccgggtggcacagcaccaccattgccgaccacaccagacctcatggagacagtgcacctgtttcctgtttgggagaacaccactccactccatctctgccagcggatcctggctccctacctgaagaaagcgcctcgccagcaaggtgcatgatcgtccaccagggcaccattctggataatgttaagaacctcttagaatttgcagaaacactccaatttatagattctgattcttcatcatggtgtgatctcagcagttttgaattctttgaagaagcagatttttcacctagccaacatcacacaggcaaagccctacagcttcagcaaagagagggcaatgggactaaacctgcaggagaacctagcccaagggtgaacaaacgtatgttgagtgagagttcacttgacccacccaaggtcttacctcctgcaaggcacagcacaattccactggtcatccttcgaaaaaaacggggccaggccagccccttagccactggagactgtagctccttcatatttgctgacgtcagcagttcaactcccaagcgttcccctgtcaaaagcctacccttctctccctcgcagttcttaaacacttccagtaaccatgaaaactcagacttggaaatgccttctttaacttccacccccctcattggtcacaaattgactgttacaacaccatttcatagagaccagactgtgaaaactcaaaaggaaaatactgtttttagaaccccagctatcaaaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgagtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtgaatgcattctcagcccggacgctggtcatg

SEQ ID NO: 178 - DNA, 993 bp, Homo sapiens
  JUN
atgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattt

SEQ ID NO: 179 - DNA, 3633 bp, Homo sapiens
  ERBB
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatga

SEQ ID NO: 180 - DNA, 5589 bp, Homo sapiens
  BRCA1
atggatttatctgctcttcgcgttgaagaagtacaaaatgtcattaatgctatgcagaaaatcttagagtgtcccatctgtctggagttgatcaaggaacctgtctccacaaagtgtgaccacatattttgcaaattttgcatgctgaaacttctcaaccagaagaaagggccttcacagtgtcctttatgtaagaatgatataaccaaaaggagcctacaagaaagtacgagatttagtcaacttgttgaagagctattgaaaatcatttgtgcttttcagcttgacacaggtttggagtatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttgcaggaaaccagtctcagtgtccaactctctaaccttggaactgtgagaactctgaggacaaagcagcggatacaacctcaaaagacgtctgtctacattgaattgggatctgattcttctgaagataccgttaataaggcaacttattgcagtgtgggagatcaagaattgttacaaatcacccctcaaggaaccagggatgaaatcagtttggattctgcaaaaaaggctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtgaagcagcatctgggtgtgagagtgaaacaagcgtctctgaagactgctcagggctatcctctcagagtgacattttaaccactcagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaagcagtattaacttcacagaaaagtagtgaataccctataagccagaatccagaaggcctttctgctgacaagtttgaggtgtctgcagatagttctaccagtaaaaataaagaaccaggagtggaaaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttatgctcgtgtacaagtttgccagaaaacaccacatcactttaactaatctaattactgaagagactactcatgttgttatgaaaacagatgctgagtttgtgtgtgaacggacactgaaatattttctaggaattgcgggaggaaaatgggtagttagctatttctgggtgacccagtctattaaagaaagaaaaatgctgaatgagcatgattttgaagtcagaggagatgtggtcaatggaagaaaccaccaaggtccaaagcgagcaagagaatcccaggacagaaagatcttcagggggctagaaatctgttgctatgggcccttcaccaacatgcccacagatcaactggaatggatggtacagctgtgtggtgcttctgtggtgaaggagctttcatcattcacccttggcacaggtgtccacccaattgtggttgtgcagccagatgcctggacagaggacaatggcttccatgcaattgggcagatgtgtgaggcacctgtggtgacccgagagtgggtgttggacagtgtagcactctaccagtgccaggagctggacacctacctgataccccagatcccccacagccactac

SEQ ID NO: 181 - DNA, 10254 bp, Homo sapiens
  BRCA2
atgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatc

SEQ ID NO: 182 - DNA, 2487 bp, Homo sapiens
  MCC
atgaattccggagttgccatgaaatatggaaacgactcctcggccgagctgagtgagctccattcagcagccctggcatcactaaagggagatatagtggaacttaataaacgtctccagcaaacagagagggaacgggaccttctggaaaagaaattggccaaggcacagtgcgagcagtcccacctcatgagagagcatgaggatgtccaggagcgaacgacgcttcgctatgaggaacgcatcacagagctccacagcgtcattgcggagctcaacaagaagatagaccgtctgcaaggcaccaccatcagggaggaagatgagtactcagaactgcgatcagaactcagccagagccaacacgaggtcaacgaggactctcgaagcatggaccaagaccagacctctgtctctatccccgaaaaccagtctaccatggttactgctgacatggacaactgcagtgacctgaactcagaactgcagagggtgctgacagggctggagaatgttgtctgcggcaggaagaagagcagctgcagcctctccgtggccgaggtggacaggcacattgagcagctcaccacagccagcgagcactgtgacctggctattaagacagtcgaggagattgagggggtgcttggccgggacctgtatcccaacctggctgaagagaggtctcggtgggagaaggagctggctgggctgagggaagagaatgagagcctgactgccatgctgtgcagcaaagaggaagaactgaaccggactaaggccaccatgaatgccatccgggaagagcgggaccggctccggaggcgggtcagagagcttcaaactcgactacagagcgtgcaggccacaggtccctccagccctggccgcctcacttccaccaaccgcccgattaaccccagcactggggagctgagcacaagcagcagcagcaatgacattcccatcgccaagattgctgagagggtgaagctatcaaagacaaggtccgaatcgtcatcatctgatcggccagtcctgggctcagaaatcagtagcataggggtatccagcagtgtggctgaacacctggcccactcacttcaggactgctccaatatccaagagattttccaaacactctactcacacggatctgccatctcagaaagcaagattagagagtttgaggtggaaacagaacggctgaatagccggattgagcacctcaaatcccaaaatgacctcctgaccataaccttggaggaatgtaaaagcaatgctgagaggatgagcatgctggtgggaaaatacgaatccaatgccacagcgctgaggctggccttgcagtacagcgagcagtgcatcgaagcctacgaactcctcctggcgctggcagagagtgagcagagcctcatcctggggcagttccgagcggcgggcgtggggtcctcccctggagaccagtcgggggatgaaaacatcactcagatgctcaagcgagctcatgactgccggaagacagctgagaacgctgccaaggccctgctcatgaagctggacggcagctgtgggggagcctttgccgtggccggctgcagcgtgcagccctgggagagcctttcctccaacagccacaccagcacaaccagctccacagccagtagttgcgacaccgagttcactaaagaagacgagcagaggctgaaggattatatccagcagctcaagaatgacagggctgcggtcaagctgaccatgctggagctggaaagcatccacatcgatcctctcagctatgacgtcaagcctcggggagacagccagaggctggatctggaaaacgcagtgcttatgcaggagctcatggccatgaaggaggagatggccgagttgaaggcccagctctacctactggagaaagagaagaaggccctggagctgaagctgagcacgcgggaggcccaggagcaggcctacctggtgcacattgagcacctgaagtccgaggtggaggagcagaaggagcagcggatgcgatccctcagctccaccagcagcggcagcaaagataaacctggcaaggagtgtgctgatgctgcctccccagctctgtccctagctgaactcaggacaacgtgcagcgagaatgagctggctgcggagttcaccaacgccattcgtcgagaaaagaagttgaaggccagagttcaagagctggtgagtgccttggagagactcaccaagagcagtgaaatccgacatcagcaatctgcagagttcgtgaatgatctaaagcgggccaacagcaacctggtggctgcctatgagaaagcaaagaaaaagcatcaaaacaaactgaagaagttagagtcgcagatgatggccatggtggagagacatgagacccaagtgaggatgctcaagcaaagaatagctctgctagaggaggagaactccaggccacacaccaatgaaacttcgctt

SEQ ID NO: 183 - DNA, 2253 bp, Homo sapiens
  EZH2, isoform 1
atgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatccct

SEQ ID NO: 184 - DNA, 1053 bp, Homo sapiens
  NIPP1/PPP1R8, isoform alpha
atggcggcagccgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtcttgctctcgggtccatgctgcacttgtctaccacaagcatctgaagagagttttcctgatagatctcaacagtacacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgataacctgacagagttcaacactgcccacaacaagcggatttctacccttaccattgaggagggaaatctggacattcaaagaccaaagaggaagaggaagaactcacgggtgacattcagtgaggatgatgagatcatcaacccagaggatgtggatccctcagttggtcgattcaggaacatggtgcaaactgcagtggtcccagtcaagaagaagcgtgtggagggccctggctccctgggcctggaggaatcagggagcaggcgcatgcagaactttgccttcagcggaggactctacgggggcctgccccccacacacagtgaagcaggctcccagccacatggcatccatgggacagcactcatcggtggcttgcccatgccatacccaaaccttgcccctgatgtggacttgactcctgttgtgccgtcagcagtgaacatgaaccctgcaccaaaccctgcagtctataaccctgaagctgtaaatgaacccaagaagaagaaatatgcaaaagaggcttggccaggcaagaagcccacaccttccttgctgatt

SEQ ID NO: 185 - DNA, 990 bp, Homo sapiens
  PPP1CA, isoform 1
atgtccgacagcgagaagctcaacctggactcgatcatcgggcgcctgctggaagtgcagggctcgcggcctggcaagaatgtacagctgacagagaacgagatccgcggtctgtgcctgaaatcccgggagatttttctgagccagcccattcttctggagctggaggcacccctcaagatctgcggtgacatacacggccagtactacgaccttctgcgactatttgagtatggcggtttccctcccgagagcaactacctctttctgggggactatgtggacaggggcaagcagtccttggagaccatctgcctgctgctggcctataagatcaagtaccccgagaacttcttcctgctccgtgggaaccacgagtgtgccagcatcaaccgcatctatggtttctacgatgagtgcaagagacgctacaacatcaaactgtggaaaaccttcactgactgcttcaactgcctgcccatcgcggccatagtggacgaaaagatcttctgctgccacggaggcctgtccccggacctgcagtctatggagcagattcggcggatcatgcggcccacagatgtgcctgaccagggcctgctgtgtgacctgctgtggtctgaccctgacaaggacgtgcagggctggggcgagaacgaccgtggcgtctcttttacctttggagccgaggtggtggccaagttcctccacaagcacgacttggacctcatctgccgagcacaccaggtggtagaagacggctacgagttctttgccaagcggcagctggtgacacttttctcagctcccaactactgtggcgagtttgacaatgctggcgccatgatgagtgtggacgagaccctcatgtgctctttccagatcctcaagcccgccgacaagaacaaggggaagtacgggcagttcagtggcctgaaccctggaggccgacccatcaccccaccccgcaattccgccaaagccaagaaa

SEQ ID NO: 186 - DNA, 1818 bp, Homo sapiens
  TAK1/MAP3K7, isoform 1B
atgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacagcctattccaagcctaaacggggccaccgtaaaactgcttcatttggcaacattctggatgtccctgagatcgtcatatcaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttca

SEQ ID NO: 187 - DNA, 204 bp, Unknown
  CMV promoter
gtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 188 - DNA, 1212 bp, Homo sapiens
  Caspase-1, isoform alpha
atggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacat

SEQ ID NO: 189 - DNA, 885 bp, Homo sapiens
  cyclin-D1/CCND1
atggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatc

SEQ ID NO: 190 - DNA, 996 bp, Homo sapiens
  A2b receptor (ADORA2B)
atgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggccta

SEQ ID NO: 191 - DNA, 1242 bp, Homo sapiens
  HHLA2, isoform 1
atgaaggcacagacagcactgtctttcttcctcattctcataacatctctgagtggatctcaaggcatattccctttggctttcttcatttatgttcctatgaatgaacaaatcgtcattggaagacttgatgaagatataattctcccttcttcatttgagaggggatccgaagtcgtaatacactggaagtatcaagatagctataaggttcacagttactacaaaggcagtgaccatttggaaagccaagatcccagatatgcaaacaggacatcccttttctataatgagattcaaaatgggaatgcgtcgctatttttcagaagagtaagccttctggacgaaggaatttacacctgctatgtaggaacagcaattcaagtgattacaaacaaagtggtgctaaaggtgggagtttttctcacacccgtgatgaagtatgaaaagaggaacacaaacagcttcttaatatgcagcgtgttaagtgtttatcctcgtccaattatcacgtggaaaatggacaacacacctatctctgaaaacaacatggaagaaacagggtctttggattctttttctattaacagcccactgaatattacaggatcaaattcatcttatgaatgtacaattgaaaattcactgctgaagcaaacatggacagggcgctggacgatgaaagatggccttcataaaatgcaaagtgaacacgtttcactctcatgtcaacctgtaaatgattatttttcaccaaaccaagacttcaaagttacttggtccagaatgaaaagtgggactttctctgtcctggcttactatctgagctcctcacaaaatacaattatcaatgaatcccgattctcatggaacaaagagctgataaaccagagtgacttctctatgaatttgatggatcttaatctttcagacagtggggaatatttatgcaatatttcttcggatgaatatactttacttaccatccacacagtgcatgtagaaccgagccaagaaacagcttcccataacaaaggcttatggattttggtgccctctgcgattttggcagcttttctgctgatttggagcgtaaaatgttgcagagcccagctagaagccaggaggagcagacaccctgctgatggagcccaacaagaaagatgttgtgtccctcctggtgagcgctgtcccagtgcacccgataatggcgaagaaaatgtgcctctttcaggaaaagta

SEQ ID NO: 192 - DNA, 1128 bp, Herpes simplex
  herpes simplex virus thymidine kinase (HSV-TK)
atggcttcgtacccctgccatcaacacgcgtctgcgttcgaccaggctgcgcgttctcgcggccatagcaaccgacgtacggcgttgcgccctcgccggcagcaagaagccacggaagtccgcctggagcagaaaatgcccacgctactgcgggtttatatagacggtcctcacgggatggggaaaaccaccaccacgcaactgctggtggccctgggttcgcgcgacgatatcgtctacgtacccgagccgatgacttactggcaggtgctgggggcttccgagacaatcgcgaacatctacaccacacaacaccgcctcgaccagggtgagatatcggccggggacgcggcggtggtaatgacaagcgcccagataacaatgggcatgccttatgccgtgaccgacgccgttctggctcctcatgtcgggggggaggctgggagttcacatgccccgcccccggccctcaccctcatcttcgaccgccatcccatcgccgccctcctgtgctacccggccgcgcgataccttatgggcagcatgaccccccaggccgtgctggcgttcgtggccctcatcccgccgaccttgcccggcacaaacatcgtgttgggggcccttccggaggacagacacatcgaccgcctggccaaacgccagcgccccggcgagcggcttgacctggctatgctggccgcgattcgccgcgtttacgggctgcttgccaatacggtgcggtatctgcagggcggcgggtcgtggtgggaggattggggacagctttcggggacggccgtgccgccccagggtgccgagccccagagcaacgcgggcccacgaccccatatcggggacacgttatttaccctgtttcgggcccccgagttgctggcccccaacggcgacctgtataacgtgtttgcctgggccttggacgtcttggccaaacgcctccgtcccatgcacgtctttatcctggattacgaccaatcgcccgccggctgccgggacgccctgctgcaacttacctccgggatggtccagacccacgtcaccaccccaggctccataccgacgatctgcgacctggcgcgcacgtttgcccgggagatgggggaggctaac

SEQ ID NO: 193 - DNA, 1173 bp, Homo sapiens
  Human TGF-beta isoform 1
atgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctga

SEQ ID NO: 194 - DNA, 699 bp, Homo sapiens
  Human VEGF
atgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 195 - DNA, 19 bp, Homo sapiens
  Human TGF-beta isoform 1 shRNA target 1
gaaacccacaacgaaatct

SEQ ID NO: 196 - DNA, 19 bp, Homo sapiens
  Human TGF-beta isoform1 shRNA target 2
gtacacacagcatatatat

SEQ ID NO: 197 - DNA, 19 bp, Homo sapiens
  Human TGF-beta isoform1 shRNA target 3
ctgctgaggctcaagttaa

SEQ ID NO: 198 - DNA, 19 bp, Homo sapiens
  Human TGF-beta isoform1 shRNA target 4
gtggagctgtaccagaaat

SEQ ID NO: 199 - DNA, 19 bp, Homo sapiens
  Human TGF-beta isoform1 shRNA target 5
gactcgccagagtggttat

SEQ ID NO: 200 - DNA, 19 bp, Homo sapiens
  Human TGF-beta isoform1 shRNA target 6
gagccgtggaggggaaatt

SEQ ID NO: 201 - DNA, 19 bp, Homo sapiens
  Human TGF-beta isoform1 shRNA target 7
cctgtgacagcagggataa

SEQ ID NO: 202 - DNA, 19 bp, Homo sapiens
  Human TGF-beta isoform1 shRNA target 8
gccctggacaccaactatt

SEQ ID NO: 203 - DNA, 19 bp, Homo sapiens
  Human TGF-beta isoform1 shRNA target 9
ccctgtacaaccagcataa

SEQ ID NO: 204 - DNA, 19 bp, Homo sapiens
  Human VEGF shRNA target 1
gagatcgagtacatcttca

SEQ ID NO: 205 - DNA, 19 bp, Homo sapiens
  Human VEGF shRNA target 2
gcagattatgcggatcaaa

SEQ ID NO: 206 - DNA, 19 bp, Homo sapiens
  Human VEGF shRNA target 3
gatagagcaagacaagaaa

SEQ ID NO: 207 - DNA, 19 bp, Homo sapiens
  Human VEGF shRNA target 4
ggagaaagcatttgtttgt

SEQ ID NO: 208 - DNA, 19 bp, Homo sapiens
  Human VEGF shRNA target 5
gatccgcagacgtgtaaat

SEQ ID NO: 209 - DNA, 19 bp, Homo sapiens
  Human VEGF shRNA target 6
gcgaggcagcttgagttaa

SEQ ID NO: 210 - DNA, 3888 bp, Artificial Sequence
  ARI-134
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggccacactgtatggactattctagagatagtccatacagtgtggcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggccgactacaagcgaattatctagagtaattcgcttgtagtcggcttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 211 - DNA, 3888 bp, Artificial Sequence
  ARI-135
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggagctggctcctggtgaattctagagattcaccaggagccagctcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggccgactacaagcgaattatctagagtaattcgcttgtagtcggcttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 212 - DNA, 3888 bp, Artificial Sequence
  ARI-136
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggcagctggaattctttctatctagagtagaaagaattccagctgcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggccgactacaagcgaattatctagagtaattcgcttgtagtcggcttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 213 - DNA, 3890 bp, Artificial Sequence
  ARI-137
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgagaattggtaccatatttgcatgtcgctatgtgttctgggaaatcaccataaacgtgaaatgtctttggatttgggaatcttataagttctgtatgagaccactccctaggatgtgaccttctacaagattctagagatcttgtagaaggtcacatcttttttcgacagatctggcgcgccatagtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactaggccgactacaagcgaattatctagagtaattcgcttgtagtcggcttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 214 - DNA, 3379 bp, Artificial Sequence
  misc_feature (1018)...(1038): n may be any nucleotide
  misc_feature (1060)...(1080): n may be any nucleotide
  source (1)...(3379): ARI-205
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgactggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagtccggatcaacgccctaggtttatgtttggatgaactgacatacgcgtatccgtcnnnnnnnnnnnnnnnnnnnnngtagtgaaatatatattaaacnnnnnnnnnnnnnnnnnnnnntacggtaacgcggaattcgcaactattttatcaattttttgcgtcgactcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 215 - DNA, 4744 bp, Artificial Sequence
  misc_feature (3377)...(3398): n may be any nucleotide
  misc_feature (3418)...(3439): n may be any nucleotide
  source (1)...(4744): ARI-206
aacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgtaactcacgttaagggattttggtcatgagcttgcgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgccaggaaacagctatgaccatgtaatacgactcactataggggatatcagctggatggcaaataatgattttattttgactgatagtgacctgttcgttgcaacaaattgataagcaatgctttcttataatgccaactttgtacaagaaagctgggtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttagatctgtttccggtcgccaccatgagcgagctgatcaaggagaacatgcacatgaagctgtacatggagggcaccgtgaacaaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaagccttcatcaaccacacccagggcatccccgacttctttaagcagtccttccctgagggcttcacatgggagagaatcaccacatacgaagacgggggcgtgctgaccgctacccaggacaccagcttccagaacggctgcatcatctacaacgtcaagatcaacggggtgaacttcccatccaacggccctgtgatgcagaagaaaacacgcggctgggaggccaacaccgagatgctgtaccccgctgacggcggcctgagaggccacagccagatggccctgaagctcgtgggcgggggctacctgcactgctccttcaagaccacatacagatccaagaaacccgctaagaacctcaagatgcccggcttccacttcgtggaccacagactggaaagaatcaaggaggccgacaaagagacctacgtcgagcagcacgagatggctgtggccaagtactgcgacctccctagcaaactggggcacagataatcgatagtttgtttgaatgaggcttcagtactttacagaatcgttgcctgcacatcttggaaacacttgctgggattacttcttcaggttaacccaacagaaggctcgagaaggtatattgctgttgacagtgagcgnnnnnnnnnnnnnnnnnnnnnntagtgaagccacagatgtannnnnnnnnnnnnnnnnnnnnntgcctactgcctcggaattcaaggggctactttaggagcaattatcttgtttactaaaactgaataccttgctatctctttgatacatttttacaaagctgaattaaaatggtataaattaaatcacttttttcaattctctagaggtaccgcatgcgtacgtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccagtcgactgaattggttcctttaaagcctgcttttttgtacaaagttggcattataaaaaagcattgctcatcaatttgttgcaacgaacaggtcactatcagtcaaaataaaatcattatttggggcccgagcttaagactggccgtcgttttacaacgtcgtgactgggaaaacatccatgctagcgttaacgcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctggctagcggtacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaag

SEQ ID NO: 216 - DNA, 3377 bp, Artificial Sequence
  misc_feature (1018)...(1036): n may be any nucleotide
  misc_feature (1058)...(1078): n may be any nucleotide
  source (1)...(3377): ARI-207
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgactggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagtccggatcaacgccctaggtttatgtttggatgaactgacatacgcgtatccgtcnnnnnnnnnnnnnnnnnnngtagtgaaatatatattaaacnnnnnnnnnnnnnnnnnnnnntacggtaacgcggaattcgcaactattttatcaattttttgcgtcgactcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 217 - DNA, 4738 bp, Artificial Sequence
  misc_feature (3377)...(3395): n may be any nucleotide
  misc_feature (3415)...(3433): n may be any nucleotide
  source (1)...(4738): ARI-208
aacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgtaactcacgttaagggattttggtcatgagcttgcgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgtttttccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcataacaccccttgtattactgtttatgtaagcagacagttttattgttcatgatgatatatttttatcttgtgcaatgtaacatcagagattttgagacacgggccagagctgccaggaaacagctatgaccatgtaatacgactcactataggggatatcagctggatggcaaataatgattttattttgactgatagtgacctgttcgttgcaacaaattgataagcaatgctttcttataatgccaactttgtacaagaaagctgggtctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttagatctgtttccggtcgccaccatgagcgagctgatcaaggagaacatgcacatgaagctgtacatggagggcaccgtgaacaaccaccacttcaagtgcacatccgagggcgaaggcaagccctacgagggcacccagaccatgaagatcaaggtggtcgagggcggccctctccccttcgccttcgacatcctggctaccagcttcatgtacggcagcaaagccttcatcaaccacacccagggcatccccgacttctttaagcagtccttccctgagggcttcacatgggagagaatcaccacatacgaagacgggggcgtgctgaccgctacccaggacaccagcttccagaacggctgcatcatctacaacgtcaagatcaacggggtgaacttcccatccaacggccctgtgatgcagaagaaaacacgcggctgggaggccaacaccgagatgctgtaccccgctgacggcggcctgagaggccacagccagatggccctgaagctcgtgggcgggggctacctgcactgctccttcaagaccacatacagatccaagaaacccgctaagaacctcaagatgcccggcttccacttcgtggaccacagactggaaagaatcaaggaggccgacaaagagacctacgtcgagcagcacgagatggctgtggccaagtactgcgacctccctagcaaactggggcacagataatcgatagtttgtttgaatgaggcttcagtactttacagaatcgttgcctgcacatcttggaaacacttgctgggattacttcttcaggttaacccaacagaaggctcgagaaggtatattgctgttgacagtgagcgnnnnnnnnnnnnnnnnnnntagtgaagccacagatgtannnnnnnnnnnnnnnnnnntgcctactgcctcggaattcaaggggctactttaggagcaattatcttgtttactaaaactgaataccttgctatctctttgatacatttttacaaagctgaattaaaatggtataaattaaatcacttttttcaattctctagaggtaccgcatgcgtacgtggccagcggccgcaggtaagccagcccaggcctcgccctccagctcaaggcgggacaggtgccctagagtagcctgcatccagggacaggccccagccgggtgctgacacgtccacctccatctcttcctcaggtctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcccaagttaacttgtttattgcagcttataatggttacaaataaagcaatagcatcacaaatttcacaaataaagcatttttttcactgcattctagttgtggtttgtccaaactcatcaatgtatcttatcatgtctggatccagtcgactgaattggttcctttaaagcctgcttttttgtacaaagttggcattataaaaaagcattgctcatcaatttgttgcaacgaacaggtcactatcagtcaaaataaaatcattatttggggcccgagcttaagactggccgtcgttttacaacgtcgtgactgggaaaacatccatgctagcgttaacgcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctggctagcggtacgcgtattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaag

SEQ ID NO: 218 - DNA, 6329 bp, Artificial Sequence
  pKD46
catcgatttattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggaattcgagctctaaggaggttataaaaaatggatattaatactgaaactgagatcaagcaaaagcattcactaaccccctttcctgttttcctaatcagcccggcatttcgcgggcgatattttcacagctatttcaggagttcagccatgaacgcttattacattcaggatcgtcttgaggctcagagctgggcgcgtcactaccagcagctcgcccgtgaagagaaagaggcagaactggcagacgacatggaaaaaggcctgccccagcacctgtttgaatcgctatgcatcgatcatttgcaacgccacggggccagcaaaaaatccattacccgtgcgtttgatgacgatgttgagtttcaggagcgcatggcagaacacatccggtacatggttgaaaccattgctcaccaccaggttgatattgattcagaggtataaaacgaatgagtactgcactcgcaacgctggctgggaagctggctgaacgtgtcggcatggattctgtcgacccacaggaactgatcaccactcttcgccagacggcatttaaaggtgatgccagcgatgcgcagttcatcgcattactgatcgttgccaaccagtacggccttaatccgtggacgaaagaaatttacgcctttcctgataagcagaatggcatcgttccggtggtgggcgttgatggctggtcccgcatcatcaatgaaaaccagcagtttgatggcatggactttgagcaggacaatgaatcctgtacatgccggatttaccgcaaggaccgtaatcatccgatctgcgttaccgaatggatggatgaatgccgccgcgaaccattcaaaactcgcgaaggcagagaaatcacggggccgtggcagtcgcatcccaaacggatgttacgtcataaagccatgattcagtgtgcccgtctggccttcggatttgctggtatctatgacaaggatgaagccgagcgcattgtcgaaaatactgcatacactgcagaacgtcagccggaacgcgacatcactccggttaacgatgaaaccatgcaggagattaacactctgctgatcgccctggataaaacatgggatgacgacttattgccgctctgttcccagatatttcgccgcgacattcgtgcatcgtcagaactgacacaggccgaagcagtaaaagctcttggattcctgaaacagaaagccgcagagcagaaggtggcagcatgacaccggacattatcctgcagcgtaccgggatcgatgtgagagctgtcgaacagggggatgatgcgtggcacaaattacggctcggcgtcatcaccgcttcagaagttcacaacgtgatagcaaaaccccgctccggaaagaagtggcctgacatgaaaatgtcctacttccacaccctgcttgctgaggtttgcaccggtgtggctccggaagttaacgctaaagcactggcctggggaaaacagtacgagaacgacgccagaaccctgtttgaattcacttccggcgtgaatgttactgaatccccgatcatctatcgcgacgaaagtatgcgtaccgcctgctctcccgatggtttatgcagtgacggcaacggccttgaactgaaatgcccgtttacctcccgggatttcatgaagttccggctcggtggtttcgaggccataaagtcagcttacatggcccaggtgcagtacagcatgtgggtgacgcgaaaaaatgcctggtactttgccaactatgacccgcgtatgaagcgtgaaggcctgcattatgtcgtgattgagcgggatgaaaagtacatggcgagttttgacgagatcgtgccggagttcatcgaaaaaatggacgaggcactggctgaaattggttttgtatttggggagcaatggcgatgacgcatcctcacgataatatccgggtaggcgcaatcactttcgtctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaatccatgggtatggacagttttccctttgatatgtaacggtgaacagttgttctacttttgtttgttagtcttgatgcttcactgatagatacaagagccataagaacctcagatccttccgtatttagccagtatgttctctagtgtggttcgttgtttttgcgtgagccatgagaacgaaccattgagatcatacttactttgcatgtcactcaaaaattttgcctcaaaactggtgagctgaatttttgcagttaaagcatcgtgtagtgtttttcttagtccgttacgtaggtaggaatctgatgtaatggttgttggtattttgtcaccattcatttttatctggttgttctcaagttcggttacgagatccatttgtctatctagttcaacttggaaaatcaacgtatcagtcgggcggcctcgcttatcaaccaccaatttcatattgctgtaagtgtttaaatctttacttattggtttcaaaacccattggttaagccttttaaactcatggtagttattttcaagcattaacatgaacttaaattcatcaaggctaatctctatatttgccttgtgagttttcttttgtgttagttcttttaataaccactcataaatcctcatagagtatttgttttcaaaagacttaacatgttccagattatattttatgaatttttttaactggaaaagataaggcaatatctcttcactaaaaactaattctaatttttcgcttgagaacttggcatagtttgtccactggaaaatctcaaagcctttaaccaaaggattcctgatttccacagttctcgtcatcagctctctggttgctttagctaatacaccataagcattttccctactgatgttcatcatctgagcgtattggttataagtgaacgataccgtccgttctttccttgtagggttttcaatcgtggggttgagtagtgccacacagcataaaattagcttggtttcatgctccgttaagtcatagcgactaatcgctagttcatttgctttgaaaacaactaattcagacatacatctcaattggtctaggtgattttaatcactataccaattgagatgggctagtcaatgataattactagtccttttcctttgagttgtgggtatctgtaaattctgctagacctttgctggaaaacttgtaaattctgctagaccctctgtaaattccgctagacctttgtgtgttttttttgtttatattcaagtggttataatttatagaataaagaaagaataaaaaaagataaaaagaatagatcccagccctgtgtataactcactactttagtcagttccgcagtattacaaaaggatgtcgcaaacgctgtttgctcctctacaaaacagaccttaaaaccctaaaggcttaagtagcaccctcgcaagctcggttgcggccgcaatcgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 219 - DNA, 22 bp, Artificial Sequence
  asd-1 primer
ccttcctaacgcaaattccctg

SEQ ID NO: 220 - DNA, 22 bp, Artificial Sequence
  asd-2 primer
ccaatgctctgcttaactcctg

SEQ ID NO: 221 - DNA, 21 bp, Artificial Sequence
  asd-3 primer
gcctcgccatgtttcagtacg

SEQ ID NO: 222 - DNA, 21 bp, Artificial Sequence
  asd-4 primer
ggtctggtgcattccgagtac

SEQ ID NO: 223 - DNA, 23 bp, Artificial Sequence
  scFv-3 primer
cataatctgggtccttggtctgc

SEQ ID NO: 224 - DNA, 5728 bp, Artificial Sequence
  pJW168 plasmid
ttactaatcgccatcttccagcaggcgcaccattgcccctgtttcactatccaggttacggatatagttcatgacaatatttacattggtccagccaccagcttgcatgatctccggtattgaaactccagcgcgggccatatctcgcgcggctccgacacgggcactgtgtccagaccaggccaggtatctctgaccagagtcatccttagcgccgtaaatcaatcgatgagttgcttcaaaaatcccttccagggcgcgagttgatagctggctggtggcagatggcgcggcaacaccattttttctgacccggcaaaacaggtagttattcggatcatcagctacaccagagacggaaatccatcgctcgaccagtttagttacccccaggctaagtgccttctctacacctgcggtgctaaccagcgttttcgttctgccaatatggattaacattctcccaccgtcagtacgtgagatatctttaaccctgatcctggcaatttcggctatacgtaacagggtgttataagcaatccccagaaatgccagattacgtatatcctggcagcgatcgctattttccatgagtgaacgaacctggtcgaaatcagtgcgttcgaacgctagagcctgttttgcacgttcaccggcatcaacgttttcttttcggatccgccgcataaccagtgaaacagcattgctgtcacttggtcgtggcagcccggaccgacgatgaagcatgtttagctggcccaaatgttgctggatagtttttactgccagaccgcgcgcctgaagatatagaagataatcgcgaacatcttcaggttctgcgggaaaccatttccggttattcaacttgcaccatgccgcccacgaccggcaaacggacagaagcattttccaggtatgctcagaaaacgcctggcgatccctgaacatgtccatcaggttcttgcgaacctcatcactcgttgcatcgaccggtaatgcaggcaaattttggtgtacgggcagtaaattggacatgtcaacggtacctgcagtctagagtcgaggcctgtttcctgtgtgaaattgttatccgctcacaattccacacattatacgagccggaagcataaagtgtaaagcctggggtgcctaatgagtgagctgtttcctgtgtgaaattgttatccgctcacaattccacacattatacgagccggaagcataaagtgtaaagcctggggtgcctaatgagtgagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagacggagtgtatccgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaatcaatgtgagttagctcactcattaggcaccccaggctttacactttatgcttccgaccatactggcttaactatgcggcatcagagcagattgtactgagagtgcaccatcgatgcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgttgatgataccgctgccttactgggtgcattagccagtctgaatgacctgtcacgggataatccgaagtggtcagactggaaaatcagagggcaggaactgctgaacagcaaaaagtcagatagcaccacatagcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgattgcggccgcaaccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgttcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagyatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatacccatgggctagctgatcagccagtgccaagcttgctcaatcaatcaccggatcccccgggaattc

SEQ ID NO: 225 - DNA, 3736 bp, Artificial Sequence
  pATIU6 plasmid
gcgcccaatacgcaaaccgcctctccccgcgcgttggccgattcattaatgcagctggcacgacaggtttcccgactggaaagcgggcagtgagcgcaacgcaatggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagttttttctcgagtagctagagaattcttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgaagcttcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaaaagcttctgtcagaccaagtttactcatatatactttagattgatttaaaacttcatttttaatttaaaaggatctaggtgaagatcctttatggtgaaggatgcgccacaggatactggcgcgcatacacagcacatctctttgcaggaaaaaaacgctatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgatgcggcttctacgctgcgcatgaaagatgatgccattattattctcgacccggtcaaccaggacgtgattaccgacggcctgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccagatgggtcagttgtatggccatgtcgccgatgaactggcgacgccgtcttccgcaattcttgatattgaacgcaaagttacggcattgacccgcagcggcgagctgccggttgataactttggcgtaccgctggcgggaagcctgatcccctggatcgacaaacagctcgataacggccagagccgcgaagagtggaaaggccaggcggaaaccaacaagattctcaatactgcctctgtgattccggttgatggtttgtgtgtgcgcgtcggcgcgctgcgctgtcacagccaggcgttcaccatcaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtagttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 226 - DNA, 26 bp, Artificial Sequence
  APR-001 Kan PrimerF
aaaaaagcttgcagctctggcccgtg

SEQ ID NO: 227 - DNA, 38 bp, Artificial Sequence
  APR-002 Kan PrimerR
aaaaaagcttttagaaaaactcatcgagcatcaaatga

SEQ ID NO: 228 - DNA, 28 bp, Artificial Sequence
  APR-003 pATI ori T148CF
acactagaaggacagtatttggtatctg

SEQ ID NO: 229 - DNA, 18 bp, Artificial Sequence
  APR-004 pATI ori T148CR
agccgtagttaggccacc

SEQ ID NO: 230 - DNA, 3203 bp, Artificial Sequence
  pSL0147 plasmid
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcggcgcgccattgggatggaacgcgttatcggcaatctggaggcaaagtttaatgataattttgcaaaaataatgcgcggaataatgatgcataaagcggctatttcgccgcctaagaaaaagatcgggggaagtgaaaaattttctaaagttcgaaattcaggtgccgatacaagggttacggtgagaaaccgtgggcaacagcccaataacatcaagttgtaattgataaggaaaagatcatgggctagcctcaataagcttcttgcctttctgcagaccaaggacccagattatgttgcagcaggccggtacctccgttctggcgcaggcgaaccaggttccgcaaaacgtcctctctttactgcgttaatccggcgattgattcaccgacacgtggtacacaatcaaggcagcgaaagctgccttttttaattccggagcctgtgtaatgaaagaaatcaccgtcactgaacctgcctttgtcacccgcttttcctgttctggctcggcctgtcgcgaccactgttgtaagggctggaaagttccatcccaatacgcgtcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 231 - DNA, 3196 bp, Artificial Sequence
  pSL0148 plasmid
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcggcgcgccattgggatggaacttccagacgacaagagtatcgcctttatttacatactttaacgctcgtttcaggccggggcggtttgcaatcttgccactgatacggtcctcaaaaatgcggtcacaatttgcactagtaagcgcattacgctgtaaatcgatattttggtcaattgttgacacccgaatatacccaatagtagccatgattttctcctttacatcagataaggaagaattttagtcgcttttctcatggaggattgctgctagcctcaataagcttcttgcctttctgcagaccaaggacccagattatgtatggaatgtatggctgtaaatgatatttcctacgggcgagaagctgaaatatggccgcgggattattctatgcttgctcgtcgagttcaatttctacgttttaatgatatccctgttcgattggtgagtaataatgcccggataatcacaggctacattgcgaagtttaatccgaaggaaaatttgattctggcttcggataaacctaaaggagttccatcccaatacgcgtcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 232 - DNA, 21 bp, Artificial Sequence
  flic-1 primer
cgttatcggcaatctggaggc

SEQ ID NO: 233 - DNA, 21 bp, Artificial Sequence
  flic-2 primer
ccagcccttacaacagtggtc

SEQ ID NO: 234 - DNA, 24 bp, Artificial Sequence
  flic-3 primer
gtctgtcaacaactggtctaacgg

SEQ ID NO: 235 - DNA, 23 bp, Artificial Sequence
  flic-4 primer
agacggtcctcatccagataagg

SEQ ID NO: 236 - DNA, 22 bp, Artificial Sequence
  fljb-1 primer sequence
ttccagacgacaagagtatcgc

SEQ ID NO: 237 - DNA, 27 bp, Artificial Sequence
  fljb-2 primer
cctttaggtttatccgaagccagaatc

SEQ ID NO: 238 - DNA, 20 bp, Artificial Sequence
  fljb-3 primer
caccaggtttttcacgctgc

SEQ ID NO: 239 - DNA, 20 bp, Artificial Sequence
  fljb-4 primer
acacgcatttacgcctgtcg

SEQ ID NO: 240 - DNA, 1518 bp, Artificial Sequence
  cytoLLO ORF
atgaaagacgcctccgcgtttaacaaggagaactccatcagctccatggccccgcccgcttccccgccggcgagccctaaaaccccgatcgagaaaaagcacgccgacgagattgacaaatatattcaaggtttagactacaataagaacaacgtgctggtgtatcacggcgatgcggtgaccaatgttccgccgcgcaagggctacaaagatggtaacgaatatatcgtggttgagaaaaagaaaaaaagcatcaaccagaacaacgccgatatccaagttgtgaacgccatcagctctttaacctatccgggcgcgctggtgaaagccaacagcgaactggtggaaaaccagcccgatgtgctgccggtgaaacgcgattctttaacgctgagcattgatttaccgggcatgacgaaccaagataacaaaatcgtggtgaagaacgcgaccaagtccaacgtgaacaacgcggtgaacacgctggtggaacgctggaacgaaaaatacgcccaagcttacccgaacgtgagcgcgaagattgactacgacgacgaaatggcctacagcgagagccagctgatcgcgaaattcggcaccgcgttcaaagcggtgaacaactctttaaacgtgaactttggcgcgatcagcgaaggcaaaatgcaagaagaggtgatcagctttaaacaaatctattataacgtgaatgttaacgagccgacgcgtccgagccgctttttcggcaaagcggtgacgaaggaacagctgcaagcgcttggcgtgaacgcggaaaaccctccggcctatatttccagcgtggcgtatggccgccaagtttatctgaagctgagcacgaacagccacagcaccaaagttaaggcggcctttgatgcggcggtgagcggcaaaagcgttagcggcgacgttgagctgacgaacatcatcaagaacagctcctttaaagcggtgatctatggcggtagcgcgaaagacgaagtgcagatcatcgacggcaatttaggtgatctgcgcgatattttaaaaaagggcgccaccttcaaccgtgagacgcccggtgtgccgatcgcctacaccaccaactttttaaaggataacgagctggccgtgatcaaaaacaattccgaatatatcgaaaccacgagcaaggcgtataccgatggcaagatcaacattgaccacagcggtggctatgtggcgcagttcaacatcagctgggatgaagtgaactatgatccggagggcaacgagatcgtgcagcacaagaactggtccgagaacaacaaatccaagctggcgcatttcaccagcagcatctatctgccgggcaacgcgcgcaacattaatgtgtacgcgaaagagtgcacgggtcttgcgtgggaatggtggcgcaccgtgatcgatgatcgcaatttaccgctggtgaaaaaccgcaacatctccatctggggcaccactttatacccgaaatattccaacaaagttgataaccctattgag

SEQ ID NO: 241 - DNA, 45 bp, Artificial Sequence
  LLO promoter
attatgtcttgacatgtagtgagtgggctggtataatgcagcaag

SEQ ID NO: 242 - DNA, 1176 bp, Artificial Sequence
  Asd Gene ORF
ctacgccaactggcgcagcattcgacgcagcggctcggcggcgccccataacaactggtcgcctacggtaaacgccgacaagaactctggccccatgttcagcttacgcagacgaccaaccggcgtagtcaacgtgccggtcaccgccgccggggttaattcgcgcatagtgatatcacgatcgttcggcaccactttcgcccacggattatgtgccgccagcagttcttccaccgtcggaatggatacctcttttttcagcttgatggtgaacgcctggctgtgacagcgcagcgcgccgacgcgcacacacaaaccatcaaccggaatcacagaggcagtattgagaatcttgttggtttccgcctggcctttccactcttcgcggctctggccgttatcgagctgtttgtcgatccaggggatcaggcttcccgccagcggtacgccaaagttatcaaccggcagctcgccgctgcgggtcaatgccgtaactttgcgttcaatatcaagaattgcggaagacggcgtcgccagttcatcggcgacatggccatacaactgacccatctgggttaacagctcgcgcatatggcgcgcgccgccgccggaggcggcctgataggtcgcgacggatacccagtcaacgagattatgggcaaagagaccgcccagcgacatcaacatcaggctaacggtacagttaccgcccacaaaggtcttcacgccattgttcaggccgtcggtaatcacgtcctggttgaccgggtcgagaataataatggcatcatctttcatgcgcagcgtagaagccgcatcaatccagtaaccctgccatccgctttcgcgcagctttggataaatttcgttggtataatcgccgccctggcaggtcacgatgatatcgagcgcttttagcgcatccagatcaaaagcgtcctgtagcgtgccggtggaggtgtcgccgaaggtgggcgccgcctgtccaaactgggaggtagaaaagaaaacagggcgaatagcgtcgaaatcgcgctcctctaccatgcgttgcatgagaacagagccgaccattccgcgccagccgataaaaccaacatttttcatagcgtttttttcctgcaaagagatgtgctgtgtatgcgcgccagtatcctgtggcgcatccttcaccat

SEQ ID NO: 243 - DNA, 589 bp, Artificial Sequence
  pBR322 Origin
ttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaa

SEQ ID NO: 244 - DNA, 3269 bp, Artificial Sequence
  pEQU6 shSCR
ctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaactttgtacaaaaaagcaggctttaaaggaaccaattcagtcgactggatccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagcaacaagatgaagagcaccaattctagagattggtgctcttcatcttgttgttttttcgagtagctagagaattcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatagtccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgct

SEQ ID NO: 245 - DNA, 4642 bp, Artificial Sequence
  pATI2.0 U6-H1 Plasmid
accggtctgtggaatgtgtgtcagttagggtgtggaaagtccccaggctccccagcaggcagaagtatgcaaagcatgcatctcaattagtcagcaaccaaccggtcttgcacctcagcaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgggccggccatgcctggcagttccctactctcgcgttaacgctagcatggatgttttcccagtcacgacgttcttaagctcgggcccttaaaggaaccaattcagtcgagaattactagtggtaccatatttgcatgtcgctatgtgttctgggaaatcaccataaacgtgaaatgtctttggatttgggaatcttataagttctgtatgagaccactccctaggtttttgtcgacagatctggcgcgccgactaccaaaatgacttcggatatgaccattatggtgcccgacttcgtaatttacgcgtacccatttggatgacggtgcgtccatgtttgttctgcatgcctgagatagtaaggccgacccccaacaatccacaaggccacgattgacacatgaggttccttttttaaacctgaacctttagttcacacaggtggctgcgccgccgtgaatggtggcagtagttacttctaatcaagctcaatccctcggctctgaagaggacatagtagacctcatctggtctttcgactacggggggtaacagatgtcggtggtataacaatcctccacgagatcatttcacgtaagcatgacttttacacctatcggaatcatataactgttaggcaatggtttatgattgggcgacagacgtcagatcggcgaacctttacgtagccccccgttcatctagacaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacttgttttttctcgagtagctagagaattcgtcgacggaactccatatatgggctatgaactaatgaccccgtaattgattactattaataactagccatccagctgatatccgccggcgctgcagctacgccaactggcgcagcattcgacgcagcggctcggcggcgccccataacaactggtcgcctacggtaaacgccgacaagaactctggccccatgttcagcttacgcagacgaccaaccggcgtagtcaacgtgccggtcaccgccgccggggttaattcgcgcatagtgatatcacgatcgttcggcaccactttcgcccacggattatgtgccgccagcagttcttccaccgtcggaatggatacctcttttttcagcttgatggtgaacgcctggctgtgacagcgcagcgcgccgacgcgcacacacaaaccatcaaccggaatcacagaggcagtattgagaatcttgttggtttccgcctggcctttccactcttcgcggctctggccgttatcgagctgtttgtcgatccaggggatcaggcttcccgccagcggtacgccaaagttatcaaccggcagctcgccgctgcgggtcaatgccgtaactttgcgttcaatatcaagaattgcggaagacggcgtcgccagttcatcggcgacatggccatacaactgacccatctgggttaacagctcgcgcatatggcgcgcgccgccgccggaggcggcctgataggtcgcgacggatacccagtcaacgagattatgggcaaagagaccgcccagcgacatcaacatcaggctaacggtacagttaccgcccacaaaggtcttcacgccattgttcaggccgtcggtaatcacgtcctggttgaccgggtcgagaataataatggcatcatctttcatgcgcagcgtagaagccgcatcaatccagtaaccctgccatccgctttcgcgcagctttggataaatttcgttggtataatcgccgccctggcaggtcacgatgatatcgagcgcttttagcgcatccagatcaaaagcgtcctgtagcgtgccggtggaggtgtcgccgaaggtgggcgccgcctgtccaaactgggaggtagaaaagaaaacagggcgaatagcgtcgaaatcgcgctcctctaccatgcgttgcatgagaacagagccgaccattccgcgccagccgataaaaccaacatttttcatagcgtttttttcctgcaaagagatgtgctgtgtatgcgcgccagtatcctgtggcgcatccttcaccataaaggatcttcacctagatccttttaaattaaaaatgaagttttaaatcaatctaaagtatatatgagtaaacttggtctgacagtctgcaggatatcccatgggcattggcgcagaaaaaaatgcctgatgcgacgctgcgcgtcttatactcccacatatgccagattcagcaacggatacggcttccccaacttgcccacttccatacgtgtcctccttaccagaaatttatccttaaccatggaagctttgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaaagctttcagaattggttaattggttgtaacactggcagagcattacgctgacttgacgggacggcgcaagctcatggatcccaattggcggccgcttaattaaacatgtgagctcgatgtacattcgaaggaccccaaaatcccttaacgtgagttacgcgtcgttccactgagcgtcagaccccgtagaaaagatcaaaggatcttcatcgatttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaatcgattccggaaacgccaggctcttccaacgcggcctttttacggttgaagagccctggccttttgctggccttttgct

SEQ ID NO: 246 - DNA, 1261 bp, Artificial Sequence
  ASD gene orf + 85 bp upstream
ctgtcagaccaagtttactcatatatactttagattgatttaaaacttcatttttaatttaaaaggatctaggtgaagatcctttatggtgaaggatgcgccacaggatactggcgcgcatacacagcacatctctttgcaggaaaaaaacgctatgaaaaatgttggttttatcggctggcgcggaatggtcggctctgttctcatgcaacgcatggtagaggagcgcgatttcgacgctattcgccctgttttcttttctacctcccagtttggacaggcggcgcccaccttcggcgacacctccaccggcacgctacaggacgcttttgatctggatgcgctaaaagcgctcgatatcatcgtgacctgccagggcggcgattataccaacgaaatttatccaaagctgcgcgaaagcggatggcagggttactggattgatgcggcttctacgctgcgcatgaaagatgatgccattattattctcgacccggtcaaccaggacgtgattaccgacggcctgaacaatggcgtgaagacctttgtgggcggtaactgtaccgttagcctgatgttgatgtcgctgggcggtctctttgcccataatctcgttgactgggtatccgtcgcgacctatcaggccgcctccggcggcggcgcgcgccatatgcgcgagctgttaacccagatgggtcagttgtatggccatgtcgccgatgaactggcgacgccgtcttccgcaattcttgatattgaacgcaaagttacggcattgacccgcagcggcgagctgccggttgataactttggcgtaccgctggcgggaagcctgatcccctggatcgacaaacagctcgataacggccagagccgcgaagagtggaaaggccaggcggaaaccaacaagattctcaatactgcctctgtgattccggttgatggtttgtgtgtgcgcgtcggcgcgctgcgctgtcacagccaggcgttcaccatcaagctgaaaaaagaggtatccattccgacggtggaagaactgctggcggcacataatccgtgggcgaaagtggtgccgaacgatcgtgatatcactatgcgcgaattaaccccggcggcggtgaccggcacgttgactacgccggttggtcgtctgcgtaagctgaacatggggccagagttcttgtcggcgtttaccgtaggcgaccagttgttatggggcgccgccgagccgctgcgtcgaatgctgcgccagttggcgtag

SEQ ID NO: 247 - DNA, 4112 bp, Artificial Sequence
  pATI2.0 synthetic v26 scramble pBR322ori.dna
accggtctgtggaatgtgtgtcagttagggtgtggaaagtccccaggctccccagcaggcagaagtatgcaaagcatgcatctcaattagtcagcaaccaaccggtcttgcacctcagcaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgggccggccatgcctggcagttccctactctcgcgttaacgctagcatggatgttttcccagtcacgacgttcttaagctcgggcccttaaaggaaccaattcagtcgagaattactagtggtacccaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaactagcaacaagatgaagagcaccaattctagagattggtgctcttcatcttgttgtttttctcgagtagctagagaattcgtcgacggaactccatatatgggctatgaactaatgaccccgtaattgattactattaataactagccatccagctgatatccgccggcgctgcagctacgccaactggcgcagcattcgacgcagcggctcggcggcgccccataacaactggtcgcctacggtaaacgccgacaagaactctggccccatgttcagcttacgcagacgaccaaccggcgtagtcaacgtgccggtcaccgccgccggggttaattcgcgcatagtgatatcacgatcgttcggcaccactttcgcccacggattatgtgccgccagcagttcttccaccgtcggaatggatacctcttttttcagcttgatggtgaacgcctggctgtgacagcgcagcgcgccgacgcgcacacacaaaccatcaaccggaatcacagaggcagtattgagaatcttgttggtttccgcctggcctttccactcttcgcggctctggccgttatcgagctgtttgtcgatccaggggatcaggcttcccgccagcggtacgccaaagttatcaaccggcagctcgccgctgcgggtcaatgccgtaactttgcgttcaatatcaagaattgcggaagacggcgtcgccagttcatcggcgacatggccatacaactgacccatctgggttaacagctcgcgcatatggcgcgcgccgccgccggaggcggcctgataggtcgcgacggatacccagtcaacgagattatgggcaaagagaccgcccagcgacatcaacatcaggctaacggtacagttaccgcccacaaaggtcttcacgccattgttcaggccgtcggtaatcacgtcctggttgaccgggtcgagaataataatggcatcatctttcatgcgcagcgtagaagccgcatcaatccagtaaccctgccatccgctttcgcgcagctttggataaatttcgttggtataatcgccgccctggcaggtcacgatgatatcgagcgcttttagcgcatccagatcaaaagcgtcctgtagcgtgccggtggaggtgtcgccgaaggtgggcgccgcctgtccaaactgggaggtagaaaagaaaacagggcgaatagcgtcgaaatcgcgctcctctaccatgcgttgcatgagaacagagccgaccattccgcgccagccgataaaaccaacatttttcatagcgtttttttcctgcaaagagatgtgctgtgtatgcgcgccagtatcctgtggcgcatccttcaccataaaggatcttcacctagatccttttaaattaaaaatgaagttttaaatcaatctaaagtatatatgagtaaacttggtctgacagtctgcaggatatcccatgggcattggcgcagaaaaaaatgcctgatgcgacgctgcgcgtcttatactcccacatatgccagattcagcaacggatacggcttccccaacttgcccacttccatacgtgtcctccttaccagaaatttatccttaaccatggaagctttgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaaagctttcagaattggttaattggttgtaacactggcagagcattacgctgacttgacgggacggcgcaagctcatggatcccaattggcggccgcttaattaaacatgtgagctcgatgtacattcgaaggaccccaaaatcccttaacgtgagttacgcgtcgttccactgagcgtcagaccccgtagaaaagatcaaaggatcttcatcgatttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaatcgattccggaaacgccaggctcttccaacgcggcctttttacggttgaagagccctggccttttgctggccttttgct

SEQ ID NO: 248 - DNA, 165 bp, Artificial Sequence
  miR-16-2
ccggatcaacgccctaggtttatgtttggatgaactgacatacttgttccactctagcagcacgtaaatattggcgtagtgaaatatatattaaacaccaatattactgtgctgctttagtgtgacagggatacagcaactattttatcaattgtttgcgtcgac

SEQ ID NO: 249 - DNA, 165 bp, Artificial Sequence
  misc_feature (55)...(75): n may be any nucleotide
  misc_feature (97)...(117): n may be any nucleotide
  source (1)...(165): microRNA backbone where Ns represent inserted anti-sense and sense microRNAs
ccggatcaacgccctaggtttatgtttggatgaactgacatacgcgtatccgtcnnnnnnnnnnnnnnnnnnnnngtagtgaaatatatattaaacnnnnnnnnnnnnnnnnnnnnntacggtaacgcggaattcgcaactattttatcaattttttgcgtcgac

SEQ ID NO: 250 - DNA, 708 bp, Salmonella typhimurium
  endA
atgtaccgtaatttctcttttgccgctgtgttgctggccgcagcgttttcaggccaggccctggccgatggcattaacaatttttctcaggccaaagcggcgagcgtcaaagtcaatgctgacgcgcccggcagcttttactgcgggtgccaaatccgctggcagggtaaaaaaggcgtcgtagacctggagtcctgcggctataaggtgcgtaaaaacgagaatcgcgccagacgcattgagtgggagcacgttgtccccgcctggcaattcggtcatcagcgccagtgctggcaggacggcgggcgaaaaaactgcgctaaagacccggtctaccgcaaaatggaaagcgatatgcataacctgcaacccgcgattggcgaagtgaatggcgatcgcggcaactttatgtatagccagtggaacggcggcgaaggtcagtacgggcagtgcgccatgaaagtagatttcaaagcgaagctcgccgagccgcccgcccgcgcccgtggcgcaatcgcccgcacttatttttatatgcgcgaccaataccaactgaaactttcccgccaacaaacgcagctttttaacgtctgggataagcagtaccccgttaccgcctgggagtgcgagcgcgatgcgcgtatcgcgaaggtccagggtaatcataatccctatgtgcaacgcgcttgccaggcgcgaaagagctaa

SEQ ID NO: 251 - protein, 235 aa, Salmonella typhimurium
  Endonuclease (endA)
MYRNFSFAAALLAAAFSGQALADGINNFSQAKAASVKVNADAPGSFYCGCQIRWQGKKGVVDLESCGYKVRKNENRARRIEWEHVVPAWQFGHQRQCWQDGGRKNCAKDPVYRKMESDMHNLQPAIGEVNGDRGNFMYSQWNGGEGQYGQCAMKVDFKAKIAEPPARARGAIARIYFYMRDQYQLKLSRQQTQLFNVWDKQYPVTAWECERDARIAKVQGNHNPYVQRACQARKS

SEQ ID NO: 252 - DNA, 78 bp, Homo sapiens
  microRNA-103a1 (miR-103a1)
tactgccctcggcttctttacagtgctgccttgttgcatatggatcaagcagcattgtacagggctatgaaggcattg

SEQ ID NO: 253 - DNA, 71 bp, Homo sapiens
  microRNA-30a (miR-30a)
gcgactgtaaacatcctcgactggaagctgtgaagccacagatgggctttcagtcggatgtttgcagctgc

SEQ ID NO: 254 - DNA, 615 bp, Artificial Sequence
  pMB1 origin of replication
aaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcg

SEQ ID NO: 255 - DNA, 913 bp, Artificial Sequence
  p15A origin of replication
gcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctagatttcagtgcaatttatctcttcaaatgtagcacctgaagtcagccccatacgatataagttgt

SEQ ID NO: 256 - DNA, 223 bp, Artificial Sequence
  pSC101 origin of replication
gagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagccc

SEQ ID NO: 257 - DNA, 602 bp, E. coli
  ColE1 origin of replication
aggatcttcttgagatcctttttttctgcgcgtaatctgctgcttgcaaacaaaaaaaccaccgctaccaacggtggtttgtttgccggatcaagagctaccaactctttttccgaaggtaactggcttcagcagagcgcagataccaaatactgtccttctagtgtagccgtagtcgggccactacttcaagaactctgtagcaccgtttgtgccatcatcgctctgctaatccggttaccagtggctgctgccagtggcgttaaggcgtgccttaccgggttggactcaagacgatagttaccggataaggcgcagcggtcgggctgaacggggggttcgtgcacacagcccagcttggagcgaacgacctacaccgaactgagataccaacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtctatttttgtgatgctcgtcaggggggcggagcctatggaaaaa

SEQ ID NO: 258 - DNA, 201 bp, Pseudomonas syringae
  pPS10 origin of replication
acctgaccggcgcggaagcgctcttgatctttttttcttgtttttacttgttgttccttgttttcgtaattttaactatatgatttataagaaaaaaaagggtttaaaggggacagattcagggtttaaaggggacagattcagggtttaaaggggacagattcagggtttaaaggggacagattcaggctgatatccaca

SEQ ID NO: 259 - DNA, 617 bp, E. coli
  RK2 origin of replication
ccgggctggttgccctcgccgctgggctggcggccgtctatggccctgcaaacgcgccagaaacgccgtcgaagccgtgtgcgagacaccgcggccgccggcgttgtggataccacgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgatgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctggcgcgtgaccgcgcacgccgaaggggggtgcccccccttctcgaaccctcccgg

SEQ ID NO: 260 - DNA, 639 bp, E. coli
  R6K alpha origin of replication
tcttacttctttgcgtagctgttaaatacagcgttgttttgataaaatcatcattatcatcgataatgctttcttcaatttttttatccttactctttaataaagcacttgctaataacttcataccttttgcaactgtcaaatttggttcatcagggtaaatgcttttaaggcatactaacaaataatcatggtcttcatcttcaactctaaactgaatttttttcatcataactcccaacaagaaccgactgtaggtcaccgggcaaacgctgaaaaataacgtcgaatgacgtcattttgcggcgtttgccctatcctgcatcgcagtagaaaatgccacaactgaaattgtgcttcagtatgtacagaaatgcaaaatctgagggatttcgtagctgaaagatcgccagtcttcgaccgtaaggataggagttgctgtaagacctgtgcggggcgttcgcttcgcgaacgggtctggcagggggcacaagcgctgtgctgtgatatatgcaaaagaagccacccacgaacgggagggcttcggcgaatcgactatagtgatctatttacccggctgattgtcgccttctagccctcgcgggcatcatgcaaccagtgcctgaatttagttatatg

SEQ ID NO: 261 - DNA, 1027 bp, E. coli
  R6K beta origin of replication
tgaagctttttttatgaatttatctgaagctgatgcagcttttctcaaggtatttgatgaaaccgtacctcccaaaaaagctaaggggtgatatatggctaaaatttacgatttccctcaaggagccgaacgccgcaggatgcaccgcaaaatccagtggaacaacgctgtaaaattatctaaaaatggctggagtaagccagaggttaaacgctggtcttttttagcattcatctcaactggctggtattactttcgcctttcggtagcagtcattttccatatcattactatttgtggtttagctgtgctcgcggcgttaagcaatacgatattctggattggtggcgcgatatgtcttgtaacctggtatacaaatgaccatcaaatttggagtactaacaatcttactatccctattgttttcggactttgggtgttaagtttagtagctgcaccactcatagattttttcagtcaaaaattgcccttttatcgtcttcttgtgcctgatgcgaagcgtgaggaagtgggcgaagatgattcttaaagccctgccctgtacggctttaacgccttctcgcggtagatctatggatgttgagaatgtagtatggttatactgcgatgcaggatagggcaaacgccgtaaaatgacgtctttgacgttatttttcagcgcttgcccggtgacctacagtcggtgcttgttgggagattttatgaagtttactagtaaaggattttatcagtgataaatatgcaaaggctattaacattttaaatgataaccttaaagaaaactactatgttttttatggtgtaaggttaagtgaaattctttttcctgcaagtgattatggtacagatgatttttttaaggagtttgaggaaataaacaacgttaccttgcctttagttgtttttgaaataaatgaacgtgaacctgtgattgtaattggttttgatgaaataaatcctgcgattcttatagagaaatccggtataaaggttttagtaatcggac

SEQ ID NO: 262 - DNA, 442 bp, E. coli
  R6K gamma origin of replication
gatcgctagtttgttttgactccatccattagggcttctaaaacgccttctaaggccatgtcagccgttaagtgttcctgtgtcactgaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgctgatcttc

SEQ ID NO: 263 - DNA, 242 bp, Enterobacteria phage P1
  P1 origin of plasmid replication oriR
tttcccgtcaacacacatcctatatcccgccagcacacattagcaacccgtcagcacacatttttatccctccagcacacatcgttttccctccagcacacatcgcgatacacttctaagccagacgtggcgcggcctgcaacgatcagggatctatatggatctaattgggatctgtatggacctgattattggatctatccagtggataatgtggataagtgaaaaaccggccaacgtag

SEQ ID NO: 264 - DNA, 792 bp, Artificial Sequence
  R1 origin of replication
ttatccacatttaactgcaagggacttccccataaggttacaaccgttcatgtcataaagcgccagccgccagtcttacagggtgcaatgtatcttttaaacacctgtttatatctcctttaaactacttaattacattcatttaaaaagaaaacctattcactgcctgtcctgtggacagacagatatgcacctcccaccgcaagcggcgggccccgaccggagccactttagttacaacacacaaaaacaacctccagaaaaaccccggtccagcgcagaaccgaaaccacaaagcccctccctcataactgaaaagcggccccgccccggcccaaagggccggaacagagtcgcttttaattatgaatgttgtaactacatcttcatcgctgtcagtcttctcgctggaagttctcagtacacgctcgtaagcggccctcacggcccgctaacgcggagatacgccccgacttcgggtaaaccctcgtcgggaccactccgaccgcgcacagaagctctctcatggctgaaagcgggtatggtctggcagggctggggatgggtaaggtgaaatctatcaatcagtaccggcttacgccgggcttcggcggttttactcctgtatcatatgaaacaacagagtgccgccttccatgccgctgatgcggcatatcctggtaacgatatctgaattgttatacatgtgtatatacgtggtaatgacaaaaataggacaagttaaaaatttacaggcgatgcaatgattcaaacacgtaatcaatatctgca

SEQ ID NO: 265 - DNA, 2920 bp, Artificial Sequence
  pWSK origin of replication
ccgatgcccttgagagccttcaacccagtcagctccttccggtgggcgcggggcatgactatcgtcgccgcacttatgactgtcttctttatcatgcaactcgtaggacagggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatc

SEQ ID NO: 266 - DNA, 37 bp, E. coli
  ColE2 origin of replication
aaaatgagaccagataagccttatcagataacagcgc

SEQ ID NO: 267 - DNA, 668 bp, Artificial Sequence
  pUC origin of replication
tgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctac

SEQ ID NO: 268 - DNA, 457 bp, Bacteriophage F1
  F1 origin of replication
gacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaattt

SEQ ID NO: 269 - DNA, 534 bp, Homo sapiens
  IL-7
atgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactga

SEQ ID NO: 270 - DNA, 987 bp, Homo sapiens
  IL12B
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 271 - DNA, 762 bp, Homo sapiens
  IL12A
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 272 - DNA, 489 bp, Homo sapiens
  IL-15
atgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttga

SEQ ID NO: 273 - DNA, 804 bp, Homo sapiens
  IL15RA
atggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatga

SEQ ID NO: 274 - DNA, 378 bp, Homo sapiens
  CXCL9
atgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataa

SEQ ID NO: 275 - DNA, 297 bp, Homo sapiens
  CXCL10
atgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctccttaa

SEQ ID NO: 276 - DNA, 285 bp, Homo sapiens
  CXCL11
atgagtgtgaagggcatggctatagccttggctgtgatattgtgtgctacagttgttcaaggcttccccatgttcaaaagaggacgctgtctttgcataggccctggggtaaaagcagtgaaagtggcagatattgagaaagcctccataatgtacccaagtaacaactgtgacaaaatagaagtgattattaccctgaaagaaaataaaggacaacgatgcctaaatcccaaatcgaagcaagcaaggcttataatcaaaaaagttgaaagaaagaatttttaa

SEQ ID NO: 277 - DNA, 465 bp, Homo sapiens
  CCL5
atgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtccacaggtcaaggatgccaaagagagagggacagcaagtctggcaggatttcctgtatgactcccggctgaacaagggcaagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttga

SEQ ID NO: 278 - DNA, 765 bp, Homo sapiens
  4-1BB Ligand
atggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataa

SEQ ID NO: 279 - DNA, 1368 bp, Homo sapiens
  TNFRSF1A
atgggcctctccaccgtgcctgacctgctgctgccactggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatga

SEQ ID NO: 280 - DNA, 1386 bp, Homo sapiens
  TNFRSF1B
atggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaa

SEQ ID NO: 281 - DNA, 1308 bp, Homo sapiens
  LTBR
atgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggccgggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactga

SEQ ID NO: 282 - DNA, 1008 bp, Homo sapiens
  FAS
atgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctag

SEQ ID NO: 283 - DNA, 903 bp, Homo sapiens
  TNFRSF6B
atgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactga

SEQ ID NO: 284 - DNA, 783 bp, Homo sapiens
  CD27
atggcacggccacatccctggtggctgtgcgttctggggaccctggtggggctctcagctactccagcccccaagagctgcccagagaggcactactgggctcagggaaagctgtgctgccagatgtgtgagccaggaacattcctcgtgaaggactgtgaccagcatagaaaggctgctcagtgtgatccttgcataccgggggtctccttctctcctgaccaccacacccggccccactgtgagagctgtcggcactgtaactctggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtgagatgctggaggccaggacagctgggcacatgcagactctggctgacttcaggcagctgcctgcccggactctctctacccactggccaccccaaagatccctgtgcagctccgattttattcgcatccttgtgatcttctctggaatgttccttgttttcaccctggccggggccctgttcctccatcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctccccctga

SEQ ID NO: 285 - DNA, 1788 bp, Homo sapiens
  TNFRSF8
atgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagacgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacggcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtga

SEQ ID NO: 286 - DNA, 1407 bp, Homo sapiens
  TNFRSF10A
atggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtga

SEQ ID NO: 287 - DNA, 1323 bp, Homo sapiens
  TNFRSF10B
atggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaa

SEQ ID NO: 288 - DNA, 780 bp, Homo sapiens
  TNFRSF10C
atggcccggatccccaagaccctaaagttcgtcgtcgtcatcgtcgcggtcctgctgccagtcctagcttactctgccaccactgcccggcaggaggaagttccccagcagacagtggccccacagcaacagaggcacagcttcaagggggaggagtgtccagcaggatctcatagatcagaacatactggagcctgtaacccgtgcacagagggtgtggattacaccaacgcttccaacaatgaaccttcttgcttcccatgtacagtttgtaaatcagatcaaaaacataaaagttcctgcaccatgaccagagacacagtgtgtcagtgtaaagaaggcaccttccggaatgaaaactccccagagatgtgccggaagtgtagcaggtgccctagtggggaagtccaagtcagtaattgtacgtcctgggatgatatccagtgtgttgaagaatttggtgccaatgccactgtggaaaccccagctgctgaagagacaatgaacaccagcccggggactcctgccccagctgctgaagagacaatgaacaccagcccagggactcctgccccagctgctgaagagacaatgaccaccagcccggggactcctgccccagctgctgaagagacaatgaccaccagcccggggactcctgccccagctgctgaagagacaatgaccaccagcccggggactcctgcctcttctcattacctctcatgcaccatcgtagggatcatagttctaattgtgcttctgattgtgtttgtttga

SEQ ID NO: 289 - DNA, 1161 bp, Homo sapiens
  TNFRSF10D
atgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagttgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtga

SEQ ID NO: 290 - DNA, 1851 bp, Homo sapiens
  TNFRSF11A
atggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttga

SEQ ID NO: 291 - DNA, 1206 bp, Homo sapiens
  TNFRSF11B
atgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataa

SEQ ID NO: 292 - DNA, 390 bp, Homo sapiens
  TNFRSF12A
atggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtga

SEQ ID NO: 293 - DNA, 882 bp, Homo sapiens
  TNFRSF13B
atgagtggcctgggccggagcaggcgaggtggccggagccgtgtggaccaggaggagcgctttccacagggcctgtggacgggggtggctatgagatcctgccccgaagagcagtactgggatcctctgctgggtacctgcatgtcctgcaaaaccatttgcaaccatcagagccagcgcacctgtgcagccttctgcaggtcactcagctgccgcaaggagcaaggcaagttctatgaccatctcctgagggactgcatcagctgtgcctccatctgtggacagcaccctaagcaatgtgcatacttctgtgagaacaagctcaggagcccagtgaaccttccaccagagctcaggagacagcggagtggagaagttgaaaacaattcagacaactcgggaaggtaccaaggattggagcacagaggctcagaagcaagtccagctctcccggggctgaagctgagtgcagatcaggtggccctggtctacagcacgctggggctctgcctgtgtgccgtcctctgctgcttcctggtggcggtggcctgcttcctcaagaagaggggggatccctgctcctgccagccccgctcaaggccccgtcaaagtccggccaagtcttcccaggatcacgcgatggaagccggcagccctgtgagcacatcccccgagccagtggagacctgcagcttctgcttccctgagtgcagggcgcccacgcaggagagcgcagtcacgcctgggacccccgaccccacttgtgctggaaggtgggggtgccacaccaggaccacagtcctgcagccttgcccacacatcccagacagtggccttggcattgtgtgtgtgcctgcccaggaggggggcccaggtgcataa

SEQ ID NO: 294 - DNA, 555 bp, Homo sapiens
  TNFRSF13C
atgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatag

SEQ ID NO: 295 - DNA, 852 bp, Homo sapiens
  TNFRSF14
atggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactga

SEQ ID NO: 296 - DNA, 1284 bp, Homo sapiens
  NGFR
atgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtga

SEQ ID NO: 297 - DNA, 555 bp, Homo sapiens
  TNFRSF17
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaa

SEQ ID NO: 298 - DNA, 1254 bp, Homo sapiens
  TNFRSF19
atggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaa

SEQ ID NO: 299 - DNA, 1293 bp, Homo sapiens
  RELT
atgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctga

SEQ ID NO: 300 - DNA, 1968 bp, Homo sapiens
  TNFRSF21
atggggacctctccgagcagcagcaccgccctcgcctcctgcagccgcatcgcccgccgagccacagccacgatgatcgcgggctcccttctcctgcttggattccttagcaccaccacagctcagccagaacagaaggcctcgaatctcattggcacataccgccatgttgaccgtgccaccggccaggtgctaacctgtgacaagtgtccagcaggaacctatgtctctgagcattgtaccaacacaagcctgcgcgtctgcagcagttgccctgtggggacctttaccaggcatgagaatggcatagagaaatgccatgactgtagtcagccatgcccatggccaatgattgagaaattaccttgtgctgccttgactgaccgagaatgcacttgcccacctggcatgttccagtctaacgctacctgtgccccccatacggtgtgtcctgtgggttggggtgtgcggaagaaagggacagagactgaggatgtgcggtgtaagcagtgtgctcggggtaccttctcagatgtgccttctagtgtgatgaaatgcaaagcatacacagactgtctgagtcagaacctggtggtgatcaagccggggaccaaggagacagacaacgtctgtggcacactcccgtccttctccagctccacctcaccttcccctggcacagccatctttccacgccctgagcacatggaaacccatgaagtcccttcctccacttatgttcccaaaggcatgaactcaacagaatccaactcttctgcctctgttagaccaaaggtactgagtagcatccaggaagggacagtccctgacaacacaagctcagcaagggggaaggaagacgtgaacaagaccctcccaaaccttcaggtagtcaaccaccagcaaggcccccaccacagacacatcctgaagctgctgccgtccatggaggccactgggggcgagaagtccagcacgcccatcaagggccccaagaggggacatcctagacagaacctacacaagcattttgacatcaatgagcatttgccctggatgattgtgcttttcctgctgctggtgcttgtggtgattgtggtgtgcagtatccggaaaagctcgaggactctgaaaaaggggccccggcaggatcccagtgccattgtggaaaaggcagggctgaagaaatccatgactccaacccagaaccgggagaaatggatctactactgcaatggccatggtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtag

SEQ ID NO: 301 - DNA, 1254 bp, Homo sapiens
  TNFRSF25
atggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtga

SEQ ID NO: 302 - DNA, 1347 bp, Homo sapiens
  EDAR
atggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctga

SEQ ID NO: 303 - DNA, 894 bp, Homo sapiens
  EDA2R
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 304 - DNA, 1137 bp, Artificial Sequence
  STING (R232 Allele)
  allele (694)...(696): nnn = CGT, CGC, CGA, CGG, AGA or AGG
atgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgacnnngctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctct

SEQ ID NO: 305 - protein, 379 aa, Homo sapiens [sequence omitted]

SEQ ID NO: 306 - protein, 379 aa, Homo sapiens
  Human STING (H232 Allele)
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 307 - protein, 379 aa, Homo sapiens [sequence omitted]

SEQ ID NO: 308 - protein, 379 aa, Homo sapiens
  Human STING (HAQ allele; R71H/G230A/R293Q)
MPHSSLHPSIPCPRGHGAQKAALVLLSACLVTLWGLGEPPEHTLRYLVLHLASLQLGLLLNGVCSLAEELHHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTADHAGIKDRVYSNSIYELLENGQRAGTCVLEYATPLQTLFAMSQYSQAGFSREDRLEQAKLFCQTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 309 - protein, 379 aa, Homo sapiens
  Human STING (AQ allele; G230A/R293Q)
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTADHAGIKDRVYSNSIYELLENGQRAGTCVLEYATPLQTLFAMSQYSQAGFSREDRLEQAKLFCQTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 310 - protein, 1025 aa, Homo sapiens [sequence omitted]

SEQ ID NO: 311 - protein, 925 aa, Homo sapiens
  RIG-I/DDX58
MTTEQRRSLQAFQDYIRKTLDPTYILSYMAPWFREEEVQYIQAEKNNKGPMEAATLFLKFLLELQEEGWFRGFLDALDHAGYSGLYEAIESWDFKKIEKLEEYRLLLKRLQPEFKTRIIPTDIISDLSECLINQECEEILQICSTKGMMAGAEKLVECLLRSDKENWPKTLKLALEKERNKFSELWIVEKGIKDVETEDLEDKMETSDIQIFYQEDPECQNLSENSCPPSEVSDTNLYSPFKPRNYQLELALPAMKGKNTIICAPTGCGKTFVSLLICEHHLKKFPQGQKGKVVFFANQIPVYEQQKSVFSKYFERHGYRVTGISGATAENVPVEQIVENNDIIILTPQILVNNLKKGTIPSLSIFTLMIFDECHNTSKQHPYNMIMFNYLDQKLGGSSGPLPQVIGLTASVGVGDAKNTDEALDYICKLCASLDASVIATVKHNLEELEQVVYKPQKFFRKVESRISDKFKYIIAQLMRDTESLAKRICKDLENLSQIQNREFGTQKYEQWIVTVQKACMVFQMPDKDEESRICKALFLYTSHLRKYNDALIISEHARMKDALDYLKDFFSNVRAAGFDEIEQDLTQRFEEKLQELESVSRDPSNENPKLEDLCFILQEEYHLNPETITILFVKTRALVDALKNWIEGNPKLSFLKPGILTGRGKTNQNTGMTLPAQKCILDAFKASGDHNILIATSVADEGIDIAQCNLVILYEYVGNVIKMIQTRGRGRARGSKCFLLTSNAGVIEKEQINMYKEKMMNDSILRLQTWDEAVFREKILHIQTHEKFIRDSQEKPKPVPDKENKKLLCRKCKALACYTADVRVIEECHYTVLGDAFKECFVSRPHPKPKQFSSFEKRAKIFCARQNCSHDWGIHVKYKTFEIPVIKIESFVVEDIATGVQTLYSKWKDFHFEKIPFDPAEMSK

SEQ ID NO: 312 - protein, 427 aa, Homo sapiens
  IRF-3, isofom 1
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKDPHDPHKIYEFVNSGVGDFSQPDTSPDTNGGGSTSDTQEDILDELLGNMVLAPLPDPGPPSLAVAPEPCPQPLRSPSLDNPTPFPNLGPSENPLKRLLVPGEEWEFEVTAFYRGRQVFQQTISCPEGLRLVGSEVGDRTLPGWPVTLPDPGMSLTDRGVMSYVRHVLSCLGGGLALWRAGQWLWAQRLGHCHTYWAVSEELLPNSGHGPDGEVPKDKEGGVFDLGPFIVDLITFTEGSGRSPRYALWFCVGESWPQDQPWTKRLVMVKVVPTCLRALVEMARVGGASSLENTVDLHISNSHPLSLTSDQYKAYLQDLVEGMDFQGPGES

SEQ ID NO: 313 - protein, 503 aa, Homo sapiens
  IRF-7, isoform A
MALAPERAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFQELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 314 - DNA, 1184 bp, Artificial Sequence
  Elongation factor 1 (EF1) alpha promoter
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 315 - DNA, 3199 bp, Artificial Sequence
  Plasmid pSL0191
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcggcgcgccattgggatggaaccgcgtgacggttctgagtgctaaatcaaacgccgttaacccgatactctctcagattattctctgtttatagtttgttaagattttattcaggttaatgttgttattatcacagtcgaatttttgaacggtatgtatgttgcgatgatcatcagaaagtattttcttattattgctctccttttgatgccatggctggctattcgctagcctcaataagcttcttgcctttctgcaggttttgatggggaagggtatgcttcagttgtgaattaaaaagtcttaaaaaacaataagtagatagagttagctaaaaattaacgcgatatttatcactttttcgcaaagttcgactggacaaaatgcatcacaattgttgtactggtatccgacacagcatttgtgtctatttttcatgtaaaggtaattttgatgtctaagattaaaggtaacgttaagtggtttaatgaatccaaaggattcggtttcattactccggaagatggcagcaaagacgtggttccatcccaatacgcgtcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 316 - DNA, 3141 bp, Artificial Sequence
  Plasmid pSL0196
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatacacttgctttaagatttgtaatggctagattgaaaacagttaaaagtattttcgtaaatatttttctctttctggataatgggctatttcaacccacagcagtgcaacatctgtcagtacttctggtgcctttattttatgggggcagctgtcagatgtgcgattaaaaaaagtggagtttcatcatgtttaatgaagtccatagtagctagcctcaataagcttcttgcctttctgcagaccaaggacccagattatgtttcatgggcaaacgataatctcaggcggtaaggccatgaaacgctatctgacctggattgtagcagcagagttactgttcgctaccggaaacctgcatgccaatgaagttgaagtcgaggttcccggattgttaaccgaccagaccgtctcttcgataggacatgaattctatcgtgcattcagcgacaaatgggaaagcgaatacaccatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 317 - DNA, 28 bp, Artificial Sequence
  csgd-1 primer
cacttgctttaagatttgtaatggctag

SEQ ID NO: 318 - DNA, 24 bp, Artificial Sequence
  csgd-2 primer
ggtgtattcgctttcccatttgtc

SEQ ID NO: 319 - DNA, 21 bp, Artificial Sequence
  csgd-3 primer
tgtgctgtccaggttaatgcc

SEQ ID NO: 320 - DNA, 23 bp, Artificial Sequence
  csgd-4 primer
gacgacggttttctcgaagtctc

SEQ ID NO: 321 - DNA, 20 bp, Artificial Sequence
  pagp-1 primer
gcgtgacggttctgagtgct

SEQ ID NO: 322 - DNA, 21 bp, Artificial Sequence
  pagp-2 primer
cgtctttgctgccatcttccg

SEQ ID NO: 323 - DNA, 24 bp, Artificial Sequence
  pagp-3 primer
acaataacgacgactccgataagg

SEQ ID NO: 324 - DNA, 24 bp, Artificial Sequence
  pagp-4 primer
ctgctgaatgtgctgattaacctg

SEQ ID NO: 325 - DNA, 664 bp, Salmonella typhimurium
  csgD
gtggagtttcatcatgtttaatgaagtccatagtagtcatggtcacacactattgttgatcacaaagccatctctgcaagctacggcattattgcaacatttaaagcaatcgctggccataaccggaaaactgcataatattcaacgttctctggaagatatctcggccggttgcattgttttaatggatatgatggaagcggataagaagcttatccactattggcaggataatttaagccgcaaaaacaataatataaaaacattattgttaaatacccctgacgattatccctaccgtgaaattgaaaactggcctcatattaacggcgtgttttacgctactgaagaccaggaacacgtggtcagcggattacagggtattctgcgtggcgaatgctatttttcacaaaaattagccagttacctgattacgcactcaggaaattaccgctacaacagcaccgagtccgcattactcactcatcgcgaaaaagagatcctcaataagttacgtattggtgcctctaataatgaaatcgcgaggtcgctatttatcagcgagaatacggttaagacacatctttataatcttttcaaaaagatagctgtcaaaaatcgcacccaggcagtttcatgggcaaacgataatctcaggcggtaa

SEQ ID NO: 326 - DNA, 4369 bp, Salmonella typhimurium
  pagP
gaattccagcacggcggccagcagcatacagatcaccagaatggtaataatgtgcaactgcggcccccatttaccgtcaaaaatcagtacgccgataatgggcgtgaacggcaaaagggcataaaacgccggggccgtggtggtaatctccgccacgtccagcatctcatgtgaaatgttctcttttttatccagatagcgttgccagaaaaagtgcgcaatcgccataccgataatggcggcgatggaaattggcagcgtagttttgaacgcgaaatcgattaacggcatctccgccgcttttgcggctaaaaccacatcgccagacgttggcgagaggatgatggcggccggagaggcgcaaatagccgccgccgcgccgcggctaatgccgacgttgaccatcaccgggaagagagtagccatgagcagtacgccaagccccgtcgcggaagagacggccagcgacatcaggcaggcgacaaaataggcggcaatcatcaacaggtagggcgagtttatgtactgtaaaggtttcgacgccagcttcacgaccatatcattcgcgccgatatgcgtcatataggcggcaaagccgcacagcatcatgatcatcatgccaagatcgccgccgcgactcataagcaaaattttgatgtattcaacaatatctgttgcggtatagccggtactggtttcgctggcaggtaataccttatgccccatcagcgcgctgataataagcagagccagaccgccgacaaataaaacgccagtggcggaatatcccttaatgatgtagcgcgctacacccacaataacgacgattccgataaggacctctataactgttagcattgtttcccctgtcttatcgacacccagagtaaaaataagaaccacaaaagtggtataaaaatgtaccgaataaaggatggcgccttactgattaaaatcacggcgcggttattttttcatgtcattgctaaagatgaaatatacttatacgaattttctgtagcactataagtattaatttattgttattttattgttttatttgttgtgctttgttttgtgttttttgtgaaagcttattaaggagcgcgtgacggttctgagtgctaaatcaaacgccgttaacccgatactctctcagattattctctgtttatagtttgttaagattttattcaggttaatgttgttattatcacagtcgaatttttgaacggtatgtatgttgcgatgatcatcagaaagtattttcttattattgctctccttttgatgccatggctggctattccttcagtctctgcggcggataaaggggggtttaacacgtttaccgataacgtcgcagaaacgtggcgacagcctgagcattatgatttgtatgtccccgccattacctggcatgcgcgctttgcctacgataaagagaaaacggatcgctataacgagcggccgtggggcgttggttttggtcagtcccgctgggacgacaaaggcaactggcatggcctctatatgatggcctttaaagattcatttaacaaatgggaacccataggcggttatggctgggaaaaaacctggcgaccgctggaagacgataattttcgccttggactgggctttaccgcaggcgttaccgcgcgcgacaactggaattatattcccatccctgtgctgttgcctttagcgtcgataggctatggtcccgctacctttcagatgacctacattccgggttcgtataacaacggaaacgtctatttcgcctggatgcgtttccagttttgatggggaagggtatgcttcagttgtgaattaaaaagtcttaaaaaacaataagtagatagagttagctaaaaattaacgcgatatttatcactttttcgcaaagttcgactggacaaaatgcatcacaattgttgtactggtatccgacacagcatttgtgtctatttttcatgtaaaggtaattttgatgtctaagattaaaggtaacgttaagtggtttaatgaatccaaaggattcggtttcattactccggaagatggcagcaaagacgtgtttgtacacttctctgcaatccagaccaatggttttaaaactctggctgaaggtcagcgcgtagagttcgaaatcactaacggtgccaaaggcccttccgctgcaaacgtaactgctctgtaagcatacgtccgacagcaagatttcaaaacccgccctttcggcgggttttttttgcgcttaacgcgccgctgcggcggaaaatagccagaatgccagcgccgtcatggcaaacgaacctaacaggttaatcagcacattcagcagcgcccagccaaagcgcccctcttgcagcaagaataccacttcggcagaaaaagtagaaaaggtcgtcaggccgccgcaaaagccggttgtgatgagcactttccacatcggatcgatatgtgtcatgcggttaaaccaggcgaaccccatgccgataataaacgcgccaagcaaatttgctgttagcgtaccgatgggaatcgcctgatgaagcggattaaaacgcatactgagcatccaccgggctacgctccccgttccaccgccgataaaaactgctaaaagaagctgtaacactgccgaatcctttatttaattgctatacaagaggagtgtaacgccgaacacgcataattggcgagtcctgacagaggtgtgggaggggatatgttcgttgcagccgggcagtttgtggtgagttctgtatgggaagagaatgcgcaagtttgcgtttcgttaatggctcaggcggcgggccgcggcgtatcgcttctggtgttgcctgaggggatattagcgcgagatgacatcgaccttgacctgccgattcgcgccgcgcagccgctggatggcgcgtttatgacgcggcttctggaagaaagcgctcataataatatgacgacgatattcactatccttgtcccgtcaacgcctggacgggcggttaatatgctggtggcgctacgggcgggtcacattgtcgcgcgttacgcgaagctgcatctctatgatgcgttttcgatgcaagaatcccaaagtattgatgccggaaccgttatcgcgcctgtgctggacgtggagggggttaaggtggggcttatgacctgttatgacctgcgctttccggacatggcgctagcgctggctttacagggggctgacgtattggcgctgccgacgggctgggttcgcggcccgttgaaagagcagcagtggtcgacgctgctggcggcgagagcgctggataccaccagctatatgattgcggccggggagtgtggtaatcgtaatattggtcaaagtcgtattatcgatccgttgggggtaacgatagccgcggcagccgatcgtccggcgctgatcgtcgcggaaatattcagagaacgaatagaccaggtgcgggagcaacttcctcttttgcagcaacgacgatttgcgccaccgcaattattatgatgtttttttacgcaaagcttgattcaccttgttacagattgctattgtgtgcgcgcgtcgaaagaccgttaatattctcaggttaatccggcgcgttacgcagcctgtttttagtgaagaaggtatctatgggtgagattagtattaccaaactgctggtggttgccgcactggttgttctgctgtttggtaccaagaagttacgtacgctgggcggagacctgggcacggcgattaaaggattcaagaaagcaatgaacgatgaagacgcgggcgttaagaaagacgtcgacggtagcgttcaggctgaaaaactctcgcacaaagagtaattgcgcgatgcgcttgctccgcagagtaaaaaaaccggcgagttgccggttttttttgcctgaaatgtaagcgtctattacacgatcatttcacttccatgcctttggcctggagatcagcatggtacgaagaacgtacaaaggggccacaggcggcatgggtaaagcccatcgccagggcttccgctttcatctcgtcaaactcttccgggctgacataacgctgtaccggcaggtgatggcggcttggctgtagatactgaccaagcgtcagcatggtaacgccgtgacggcgtaagtcgcgcataacctcaatgatttccgcattggtttcgcctaagcccaccatcagacccgattttgtcggaatttccgggtgcgcttctttgaagcgttccagtaatttcagcgaccagttgtaatcggcgcccggacgaacctggcggtaaatacgcggcacgttttccaggttgtggttaaacacatccggcggcgtcgcgttaaggatatc

SEQ ID NO: 327 - DNA, 1500 bp, Salmonella typhimurium
  fliC
aaggaaaagatcatggcacaagtcattaatacaaacagcctgtcgctgttgacccagaataacctgaacaaatcccagtccgctctgggcaccgctatcgagcgtctgtcttccggtctgcgtatcaacagcgcgaaagacgatgcggcaggtcaggcgattgctaaccgttttaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggtgccaacgacggtgaaactatcgatatcgatctgaagcagatcaactctcagaccctgggtctggatacgctgaatgtgcaacaaaaatataaggtcagcgatacggctgcaactgttacaggatatgccgatactacgattgctttagacaatagtacttttaaagcctcggctactggtcttggtggtactgaccagaaaattgatggcgatttaaaatttgatgatacgactggaaaatattacgccaaagttaccgttacggggggaactggtaaagatggctattatgaagtttccgttgataagacgaacggtgaggtgactcttgctggcggtgcgacttccccgcttacaggtggactacctgcgacagcaactgaggatgtgaaaaatgtacaagttgcaaatgctgatttgacagaggctaaagccgcattgacagcagcaggtgttaccggcacagcatctgttgttaagatgtcttatactgataataacggtaaaactattgatggtggtttagcagttaaggtaggcgatgattactattctgcaactcaaaataaagatggttccataagtattaatactacgaaatacactgcagatgacggtacatccaaaactgcactaaacaaactgggtggcgcagacggcaaaaccgaagttgtttctattggtggtaaaacttacgctgcaagtaaagccgaaggtcacaactttaaagcacagcctgatctggcggaagcggctgctacaaccaccgaaaacccgctgcagaaaattgatgctgctttggcacaggttgacacgttacgttctgacctgggtgcggtacagaaccgtttcaactccgctattaccaacctgggcaacaccgtaaacaacctgacttctgcccgtagccgtatcgaagattccgactacgcgaccgaagtttccaacatgtctcgcgcgcagattctgcagcaggccggtacctccgttctggcgcaggcgaaccaggttccgcaaaacgtcctctctttactgcgttaa

SEQ ID NO: 328 - DNA, 1528 bp, Salmonella typhimurium
  fljB
aaattttatggcacaagtaatcaacactaacagtctgtcgctgctgacccagaataacctgaacaaatcccagtccgcactgggcaccgctatcgagcgtctgtcttctggtctgcgtatcaacagcgcgaaagacgatgcggcaggtcaggcgattgctaaccgtttcaccgcgaacatcaaaggtctgactcaggcttcccgtaacgctaacgacggtatctccattgcgcagaccactgaaggcgcgctgaacgaaatcaacaacaacctgcagcgtgtgcgtgaactggcggttcagtctgctaacagcaccaactcccagtctgacctcgactccatccaggctgaaatcacccagcgcctgaacgaaatcgaccgtgtatccggccagactcagttcaacggcgtgaaagtcctggcgcaggacaacaccctgaccatccaggttggcgccaacgacggtgaaactatcgatatcgatctgaagcagatcaactctcagaccctgggtctggactcactgaacgtgcagaaagcgtatgatgtgaaagatacagcagtaacaacgaaagcttatgccaataatggtactacactggatgtatcgggtcttgatgatgcagctattaaagcggctacgggtggtacgaatggtacggcttctgtaaccggtggtgcggttaaatttgacgcagataataacaagtactttgttactattggtggctttactggtgctgatgccgccaaaaatggcgattatgaagttaacgttgctactgacggtacagtaacccttgcggctggcgcaactaaaaccacaatgcctgctggtgcgacaactaaaacagaagtacaggagttaaaagatacaccggcagttgtttcagcagatgctaaaaatgccttaattgctggcggcgttgacgctaccgatgctaatggcgctgagttggtcaaaatgtcttataccgataaaaatggtaagacaattgaaggcggttatgcgcttaaagctggcgataagtattacgccgcagattacgatgaagcgacaggagcaattaaagctaaaactacaagttatactgctgctgacggcactaccaaaacagcggctaaccaactgggtggcgtagacggtaaaaccgaagtcgttactatcgacggtaaaacctacaatgccagcaaagccgctggtcatgatttcaaagcacaaccagagctggcggaagcagccgctaaaaccaccgaaaacccgctgcagaaaattgatgccgcgctggcgcaggtggatgcgctgcgctctgatctgggtgcggtacaaaaccgtttcaactctgctatcaccaacctgggcaataccgtaaacaatctgtctgaagcgcgtagccgtatcgaagattccgactacgcgaccgaagtttccaacatgtctcgcgcgcagattctgcagcaggccggtacttccgttctggcgcaggctaaccaggtcccgcagaacgtgctgtctctgttacgttaa

SEQ ID NO: 329 - DNA, 589 bp, Artificial Sequence
  Woodchuck Hepatitis Virus Posttranscriptional Regulatory Element (WPRE)
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 330 - protein, 398 aa, Danio rerio
  WT Zebrafish STING (zfSTING)
MSVMGEDALVPRARSRLPVMCAAGLGFLTLAVAWLLDSDKFSERAGIIAFGLMLERFIYCICLLAEELLFHSRQRYHGRMSEIFRACFRGSGILGMCAIFLMLMLGGVSFSVKQWSHFNLMCAGYMLLNSLGVLGPAPVEISEICEAKKMNVAHGLAWSFYIGYLKFLLPALEVNVREYSRRERLSSPRLHILLPLNARVPSKPEEEDTNVVFHENLPDLKLDRAGVRKRSYTNSVYKITHNNETFSCILEYATPLLTLYQMSQESSAGFGERERKQQVLLFYRTLSQILDNSLECRNRYRLILLNDEHTGDPHYLSRELFQNLKQQDGEIFMDPTNEVHPVPEEGPVGNCNGALQATFHEEPMSDEPTLMFSRPQSLRSEPVETTDYFNPSSAMKQN

SEQ ID NO: 331 - protein, 381 aa, Sarcophilus harrisii
  WT Tasmanian devil STING (tazSTING)
MPRSHLHPSIPQPRGWGAQKAACVLLSLCMAAVYILGESAAFTLQWLLFYFTTVQVGLLLKGAYCLAEELYHIQSRHQGSYWQAIQACIHYPFQRISLLLLSGYFYVTLSNKPNPSLTWTFALLGLSHALSFILGLQNLTSAEISEVCEKRHLNVAHGLAWSYYIGYLKLILPGLQTRIQIYNQFNKDVLRSPEGHRLHILIPLDCSVPDNLSQADPNIQFLQELPQHKLDRAGIKGRIYTNSIYKISEDGQPAEVCVLEFATPLQTLFAMSQDARAGFSREDRLEQAKLFCRTLEDILEDAPEARDCCRLVVYQEPEDKAVSNFSLSKEILRHLRQERQEEFAIGPKRAMTVTTSSTLSQEPQLLISGMEQPLSLRTDGF

SEQ ID NO: 332 - protein, 381 aa, Artificial Sequence
  Tasmanian devil STING (tazSTING) C206Y
MPRSHLHPSIPQPRGWGAQKAACVLLSLCMAAVYILGESAAFTLQWLLFYFTTVQVGLLLKGAYCLAEELYHIQSRHQGSYWQAIQACIHYPFQRISLLLLSGYFYVTLSNKPNPSLTWTFALLGLSHALSFILGLQNLTSAEISEVCEKRHLNVAHGLAWSYYIGYLKLILPGLQTRIQIYNQFNKDVLRSPEGHRLHILIPLDYSVPDNLSQADPNIQFLQELPQHKLDRAGIKGRIYTNSIYKISEDGQPAEVCVLEFATPLQTLFAMSQDARAGFSREDRLEQAKLFCRTLEDILEDAPEARDCCRLVVYQEPEDKAVSNFSLSKEILRHLRQERQEEFAIGPKRAMTVTTSSTLSQEPQLLISGMEQPLSLRTDGF

SEQ ID NO: 333 - protein, 381 aa, Artificial Sequence
  Tasmanian devil STING (tazSTING) R284G
MPRSHLHPSIPQPRGWGAQKAACVLLSLCMAAVYILGESAAFTLQWLLFYFTTVQVGLLLKGAYCLAEELYHIQSRHQGSYWQAIQACIHYPFQRISLLLLSGYFYVTLSNKPNPSLTWTFALLGLSHALSFILGLQNLTSAEISEVCEKRHLNVAHGLAWSYYIGYLKLILPGLQTRIQIYNQFNKDVLRSPEGHRLHILIPLDCSVPDNLSQADPNIQFLQELPQHKLDRAGIKGRIYTNSIYKISEDGQPAEVCVLEFATPLQTLFAMSQDARAGFSREDGLEQAKLFCRTLEDILEDAPEARDCCRLVVYQEPEDKAVSNFSLSKEILRHLRQERQEEFAIGPKRAMTVTTSSTLSQEPQLLISGMEQPLSLRTDGF

SEQ ID NO: 334 - protein, 379 aa, Artificial Sequence
  WT human STING-tasmanian devil CTT
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQERQEEFAIGPKRAMTVTTSSTLSQEPQLLISGMEQPLSLRTDGF

SEQ ID NO: 335 - protein, 379 aa, Artificial Sequence
  human STING C206Y-tasmanian devil CTT
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDYGVPDNLSMADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQERQEEFAIGPKRAMTVTTSSTLSQEPQLLISGMEQPLSLRTDGF

SEQ ID NO: 336 - protein, 379 aa, Artificial Sequence
  human STING R284G-tasmanian devil CTT
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSREDGLEQAKLFCRTLEDILADAPESQNNCRLIAYQEPADDSSFSLSQEVLRHLRQERQEEFAIGPKRAMTVTTSSTLSQEPQLLISGMEQPLSLRTDGF

SEQ ID NO: 337 - protein, 376 aa, Artificial Sequence
  WT human STING delTRAF6 binding motif (Asp-Phe-Ser at C-terminal removed)
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRT

SEQ ID NO: 338 - protein, 377 aa, Felis catus
  WT cat STING (catSTING)
MPRTGLHPSIPRPRGMGAQKAALVLLAVCLAALWRLGESPDHTLRWLVLHLASLQLGLLFTGVCHLTEELCHLHSRYQGSYWRAMKACLGSPVRSGALLLLSCYFYSTLPSTDLPFTWMLALLGLSQALNILLDLQGLAPAEVSAVCEKKNFNVAHGLAWSYYIGYLRLILPGLPARVLTCNQLHNNILRGTGSHRLHILFPLDCGVPDDMSVADPNIRFLYELPQQSADRAGIKGRVYTNSVYALLENGQQAGICVLEYATPLQTLFAMSQDGRAGFSREDRLEQAKLFCRILEDILADTPECQNNCRLIVYQEPEEGSNFSLSQEILRHLRQEEREVTVGSVGTSMVRNPSVLSQEPNLLISGMEQPLPLRTDVF

SEQ ID NO: 339 - protein, 377 aa, Artificial Sequence
  cat STING C205Y
MPRTGLHPSIPRPRGMGAQKAALVLLAVCLAALWRLGESPDHTLRWLVLHLASLQLGLLFTGVCHLTEELCHLHSRYQGSYWRAMKACLGSPVRSGALLLLSCYFYSTLPSTDLPFTWMLALLGLSQALNILLDLQGLAPAEVSAVCEKKNFNVAHGLAWSYYIGYLRLILPGLPARVLTCNQLHNNILRGTGSHRLHILFPLDYGVPDDMSVADPNIRFLYELPQQSADRAGIKGRVYTNSVYALLENGQQAGICVLEYATPLQTLFAMSQDGRAGFSREDRLEQAKLFCRILEDILADTPECQNNCRLIVYQEPEEGSNFSLSQEILRHLRQEEREVTVGSVGTSMVRNPSVLSQEPNLLISGMEQPLPLRTDVF

SEQ ID NO: 340 - protein, 377 aa, Artificial Sequence
  cat STING R283G
MPRTGLHPSIPRPRGMGAQKAALVLLAVCLAALWRLGESPDHTLRWLVLHLASLQLGLLFTGVCHLTEELCHLHSRYQGSYWRAMKACLGSPVRSGALLLLSCYFYSTLPSTDLPFTWMLALLGLSQALNILLDLQGLAPAEVSAVCEKKNFNVAHGLAWSYYIGYLRLILPGLPARVLTCNQLHNNILRGTGSHRLHILFPLDCGVPDDMSVADPNIRFLYELPQQSADRAGIKGRVYTNSVYALLENGQQAGICVLEYATPLQTLFAMSQDGRAGFSREDGLEQAKLFCRILEDILADTPECQNNCRLIVYQEPEEGSNFSLSQEILRHLRQEEREVTVGSVGTSMVRNPSVLSQEPNLLISGMEQPLPLRTDVF

SEQ ID NO: 341 - protein, 377 aa, Callithrix jacchus
  WT Marmoset STING
MPHSSLHPSIPHPRGHGAQEAALVLLSVCLVTLWWLREAPEDILRFLVLHLASLQLGLLLNRLCSLAEELRHVHTRYQGSYWRAVRACLGCPIRLGAQLLLSIYFYCFLPNGRPFTWMLALLGFSQALNILLGLKGLAPAEISAVCEKRNFNVAHGLAWSYYIGYLRLILPGFQARIRTYNQHNNNVLRGPASQRLYILFPLDCGVPDNLSTADPNIRFLDKLPQETIDRAGIKGRVYTNSIYELLENGQRAGACVLEYASPLQTLFAMSQYGQAGFSREDRLEQAKLFCRTLEDILADAPESQNNCRLIVYEEPADGSSFLLSQEVLQHLRQEEEEEVTVGSLKTSEVPSTSTMSQEPELLISGMEKPLPLRSDLF

SEQ ID NO: 342 - protein, 378 aa, Bos taurus
  WT Cattle/Bovine STING
MPHSSLHPSIPQPRGLRAQKAALVLLSACLVALWGLGEPPDYTLKWLVLHLASQQMGLLIKGICSLAEELCHVHSRYHGSYWRAVRACLCSSMRCGALLLLSCYFYCSLPNMADLPFTWMLALLGLSQALNILLGLQGLAPAEVSAICEKRNFNVAHGLAWSYYIGYLRLILPGLPARIQIYNQFHNNTLQGAGSHRLHILFPLDCGVPDDLNVADPNIRFLHELPQQSADRAGIKGRVYTNSIYELLENGQRAGVCVLEYATPLQTLFAMSQDGRAGFSREDRLEQAKLFCRTLEDILANAPESQNNCRLIVYQEPAEGSSFSLSQEILQHLRQEEREVTMGSTETSVMPGSSVLSQEPELLISGLEKPLPLRSDVF

SEQ ID NO: 343 - protein, 375 aa, Struthio camelus australis
  WT Ostrich STING
MAHESGTPSNPATPLIPKAREGRAQHAAYVLLALCAAALYLAGEPVVHIARSFTSHFVALQIGALLKGICYLVEEIFHLETRHRGSFRRALSACLHLRWHVTLLLVCGSAYVALLDGDEQPLGLHLGLACLCQLLILALGLHKPSAVEISEMSERSKQNVAHGLAWSYYVGYLKIVLPRLKESMENIGRTNPNMLAHKETWKLHILVPLSCNICDDLEKADSNIQYAMDLPETTLTRAGTKKRVYRNTLYKIKDEDKFRFCVVEYATPLQSLYAMSQDECAAFSREDRIEQAKLFYRTLEEILQSAKECAGTYRLIVYEESGEAETHFLSREILRHLQQQRQEEYTVCDGTLCSTDLSLQISESDLPQPLRSDCL

SEQ ID NO: 344 - protein, 382 aa, Nipponia nippon
  WT Crested ibis STING
MSQEPQWLSHPTALLIPKARGGRAQHAVYLLLALCAAVLYLAGEPLVPSARSLISHFMALQIGVLLKGTCYLAEEIFHLQSRHHGSFWRALSACFPLRWHGLMLLVCGSAYVALLEDGQPLGLHLGLASLCQLLILALGLHKPSAVEMSEMSERSKQNVAHGLAWSYYVGYLKIVLPRVKKSMEEFSRANPNVLARRETWKLHILVPLSCDVYDDLEKADSNIQYLMDLPETTLTRAGTKKRVYKHSLYTIRDEGNKLWHCAVEYATPLQSLYAMSQDEYAAFSREDRLEQAKLFYRTLEEILKGSKECAGTYRLIVYEESGEAETHSLSRDILWHLRQQCHEEYTVYEGNQPHNPSTTLHSTELNLQISESDLPQPLRSDC

SEQ ID NO: 345 - protein, 380 aa, Latimeria chalumnae
  WT Coelacanth STING (UniProtKB entry H3A3G4)
FGLQNMSAIIPQPRGNRANQMAYFIITVILMLLWIFRNIMDNVLEVIALHILLLQGAAIMKGICNFAEEVNHVQPRYGGSYWKALEACLNLSKYDVMKIVFAGVLWWHFSSSLFVVWFLHLLVSCLCHLLNNVLGVLKPSPVEVSEIYERNRIGVAHGLAWSYYLGYLKLVLPELEDRIKSYNVSHGNLLKHKETWRLHILLPLSCSIFDNLADVDSNIEFLDNLSELQINRAGIKGRSYKHSLYQVLDEDKRPHYCILEYATPLKSLLEMSKEASAEFTKEDRLEQTKLFYRTLKDILDNSQECRGRFRLVIYDGREDSGKSHFLSKELLRHLNQQQKEEYFMSEQTQPNSSSTSCLSTEPQLMISDTDAPHTLKRQVC

SEQ ID NO: 346 - protein, 405 aa, Latimeria chalumnae
  WT Coelacanth STING (Isoform X1; NCBI Accession No. XP_005989369.1)
MCFIQVLDITIITQMLQGEYFGLQNMSAIIPQPRGNRANQMAYFIITVILMLLWIFRNIMDNVLEVIALHILLLQGAAIMKGICNFAEEVNHVQPRYGGSYWKALEACLNLSKYDVMKIVFAGVLWWHFSSSLFVVWFLHLLVSCLCHLLNNVLGVLKPSPVEVSEIYERNRIGVAHGLAWSYYLGYLKLVLPELEDRIKSYNVSHGNLLKHKETWRLHILLPLSCSIFDNLADVDSNIEFLDNLSELQINRAGIKGRSYKHSLYQVLDEDKRPHYCILEYATPLKSLLEMSKEASAEFTKEDRLEQTKLFYRTLKDILDNSQECRGRFRLVIYDDCQDVLDGEDSGKSHFLSKELLRHLNQQQKEEYFMSEQTQPNSSSTSCLSTEPQLMISDTDAPHTLKSGF

SEQ ID NO: 347 - protein, 378 aa, Sus scrofa
  WT Boar STING
MPYSSLHPSIPQPRGLRAQVAALVLLGACLVALWGLGELPEYTLRWLVLHLASQQIGLLVKGLCSLAEELCHVHSRYQSSYWRAARACLGCPIRCGALLLLSCYFYFSIRDKAGLPLPWMLALLGLSQALNILLGLQHLAPAEVSAICEKRNFNVAHGLAWSYYIGYLRLILPGLRARIQAYNQRHKNVLGGIGNHRLHILFPLDCGVPDDLSVADPNIRFLHELPQQSADRAGIKGRVYTNSIYELLENGQPAGVCVLGYATPLQTLFAMSQDGRAGFSREDRLEQAKLFCRTLEDILADAPEAQNNCRLIVYQEPTEGGSFSLSQEILRHLRQEEREVTMGSAETSVVPTSSTLSQEPELLISGMEQPLPLRSDIF

SEQ ID NO: 348 - protein, 380 aa, Rousettus aegyptiacus
  WT Bat STING
MSHSSLHPSVPRPRGRRARNIAAFVLLIVCLAALWLSGKPSEYTLRCLVLHLASQQLGLLSNRVCYLAEELSHIHSRYQGNYWRAVRACLSCPIRFGVVLLVSFFFYTSLPNIDDLPLTWMLAHLGLSEALNILLGLRGLTPAEVSTVCEQRHFNVAHGLAWSYYIGYLRLILPGLRARIHTYNQLHGNTLQGVGSHRLYILFPLDCGVLDDLSAADPNIRFLRELPRQSSDRAGIKNRVYTNSVYELLEKGKPVGTCVLEYATPLQTLFAMSQDARAGFSQEDRLEQAKLFCRTLADILADDPESQKSCRLIVYQEPTEESDFSLSQAILKHLRQEEKEEVTVGTVGTYEAPGSSTLHQEPELLISGMDQPLPLRTDIF

SEQ ID NO: 349 - protein, 387 aa, Trichechus manatus latirostris
  WT Manatee STING
MVEMPHSSLHPSIPRHRGHGIQKAAFVLLVACLVALWELGEPPGHTLQWLVCQLASLQLGLLLKVICSLAEELCHVHSRYQSSYWRAVRACMGCPIRRGALLLLSCYFYFCFPNMADLPLTWTLALLGLLQAMNILLSLQGLTPAEISAICEKRNLNVAHGLAWSYYIGYLRLILPGLQDRIRIYNLQHNNMLRGTGSQRLHILFPLDCGVPNDLSVADANIRFLQKLPQQSADCAGIKGRVYTNSVYQLLEHGQPAGICVLEYATPLQTLFAMSQDGRAGFSREDRLEQAKLFCRTLEDILADAPEYQNNCRLIVYQESAEGSSFSLSQEILRHLRQEEREEVTVGSVGTSVVPSPSSPSTSSLSQEPKLLISGMEQPLPLRTDVF

SEQ ID NO: 350 - protein, 378 aa, Callorhinchus milii
  WT Ghost shark STING
MSDSIPRPRGKVATYVGLILMSGLACLYFMLTPDYHIKFIVQQVAQQLIVSFFALCLLRLCEFVEELGHKQTRYQNSWVRALNASLDWKKYGFCLLISLLFNWVLPYEKHMSYAVPTVGQTISLTCFCVLFLKVFQLDVLSPAQISEISETNKCNVAHGLAWSYYLGYLKIVLPKLEEKINQYHREYGNVLQQKGKKLYILIPFSCKVLDKLEKVDTNIVFYQNLPELLVDRAGIKSRSYKHSIYLIYDQKKQQPHHCILEYATPLRSLFEMTNDSAAAFSKEQRLDQAKLFYRTLKSILNNVPEVTGSYRLIPYDDDLEGAELGPHFVSEEILKHMRQELTEYPVAEPSNANETDCMSSEPHLMISDDPKPLRSYCP

SEQ ID NO: 351 - protein, 378 aa, Mus musculus
  WT Mouse STING
MPYSNLHPAIPRPRGHRSKYVALIFLVASLMILWVAKDPPNHTLKYLALHLASHELGLLLKNLCCLAEELCHVQSRYQGSYWKAVRACLGCPIHCMAMILLSSYFYFLQNTADIYLSWMFGLLVLYKSLSMLLGLQSLTPAEVSAVCEEKKLNVAHGLAWSYYIGYLRLILPGLQARIRMFNQLHNNMLSGAGSRRLYILFPLDCGVPDNLSVVDPNIRFRDMLPQQNIDRAGIKNRVYSNSVYEILENGQPAGVCILEYATPLQTLFAMSQDAKAGFSREDRLEQAKLFCRTLEEILEDVPESRNNCRLIVYQEPTDGNSFSLSQEVLRHIRQEEKEEVTMNAPMTSVAPPPSVLSQEPRLLISGMDQPLPLRTDLI

SEQ ID NO: 352 - protein, 43 aa, Homo sapiens
  Human STING C-terminal tail (CTT)
EKEEVTVGSLKTSAVPSTSTMSQEPELLISGMEKPLPLRTDFS

SEQ ID NO: 353 - protein, 43 aa, Sarcophilus harrisii
  Tasmanian devil STING C-terminal tail (CTT)
RQEEFAIGPKRAMTVTTSSTLSQEPQLLISGMEQPLSLRTDGF

SEQ ID NO: 354 - protein, 43 aa, Callithrix jacchus
  Marmoset STING C-terminal tail (CTT)
EEEEVTVGSLKTSEVPSTSTMSQEPELLISGMEKPLPLRSDLF

SEQ ID NO: 355 - protein, 42 aa, Bos taurus
  Cattle/Bovine STING C-terminal tail (CTT)
EREVTMGSTETSVMPGSSVLSQEPELLISGLEKPLPLRSDVF

SEQ ID NO: 356 - protein, 42 aa, Felis catus
  Cat STING C-terminal tail (CTT)
EREVTVGSVGTSMVRNPSVLSQEPNLLISGMEQPLPLRTDVF

SEQ ID NO: 357 - protein, 35 aa, Struthio camelus australis
  Ostrich STING C-terminal tail (CTT)
RQEEYTVCDGTLCSTDLSLQISESDLPQPLRSDCL

SEQ ID NO: 358 - protein, 42 aa, Sus scrofa
  Boar STING C-terminal tail (CTT)
EREVTMGSAETSVVPTSSTLSQEPELLISGMEQPLPLRSDIF

SEQ ID NO: 359 - protein, 43 aa, Rousettus aegyptiacus
  Bat STING C-terminal tail (CTT)
EKEEVTVGTVGTYEAPGSSTLHQEPELLISGMDQPLPLRTDIF

SEQ ID NO: 360 - protein, 48 aa, Trichechus manatus latirostris
  Manatee STING C-terminal tail (CTT)
EREEVTVGSVGTSVVPSPSSPSTSSLSQEPKLLISGMEQPLPLRTDVF

SEQ ID NO: 361 - protein, 43 aa, Nipponia nippon
  Crested ibis STING C-terminal tail (CTT)
CHEEYTVYEGNQPHNPSTTLHSTELNLQISESDLPQPLRSDCF

SEQ ID NO: 362 - protein, 43 aa, Latimeria chalumnae
  Coelacanth STING (SEQ ID NO:345) C-terminal tail (CTT)
QKEEYFMSEQTQPNSSSTSCLSTEPQLMISDTDAPHTLKRQVC

SEQ ID NO: 363 - protein, 42 aa, Latimeria chalumnae
  Coelacanth STING (SEQ ID NO:346) C-terminal tail (CTT)
QKEEYFMSEQTQPNSSSTSCLSTEPQLMISDTDAPHTLKSGF

SEQ ID NO: 364 - protein, 71 aa, Danio rerio
  Zebrafish STING C-terminal tail (CTT)
DGEIFMDPTNEVHPVPEEGPVGNCNGALQATFHEEPMSDEPTLMFSRPQSLRSEPVETTDYFNPSSAMKQN

SEQ ID NO: 365 - protein, 38 aa, Callorhinchus milii
  Ghost shark STING C-terminal tail (CTT)
LTEYPVAEPSNANETDCMSSEPHLMISDDPKPLRSYCP

SEQ ID NO: 366 - protein, 43 aa, Mus musculus
  Mouse STING C-terminal tail (CTT)
EKEEVTMNAPMTSVAPPPSVLSQEPRLLISGMDQPLPLRTDLI

SEQ ID NO: 367 - protein, 18 aa, Artificial Sequence
  T2A peptide
EGRGSLLTCGDVEENPGP

SEQ ID NO: 368 - protein, 19 aa, Artificial Sequence
  P2A peptide
ATNFSLLKQAGDVEENPGP

SEQ ID NO: 369 - protein, 20 aa, Artificial Sequence
  E2A peptide
QCTNYALLKLAGDVESNPGP

SEQ ID NO: 370 - protein, 22 aa, Artificial Sequence
  F2A peptide
VKQTLNFDLLKLAGDVESNPGP

SEQ ID NO: 371 - DNA, 753 bp, Artificial Sequence
  Hepatitis B virus posttranscriptional regulatory element (HPRE)
atgcatgtattcaatctaagcaggctttcactttctcgccaacttacaaggcctttctgtgtaaacaatacctgaacctttaccccgttgcccggcaacggccacctctgtgccaagtgtttgctgacgcaacccccactggctggggcttggtcatgggccatcagcgcatgcgtggaaccttttcggctcctctgccgatccatactgcggaactcctagccgcttgttttgctcgcagcaggtctggagcaaacattatcgggactgataactctgttgtcctatcccgcaaatatacatcgtttccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccaaatattgcccaaggtcttacataagaggactcttggactctcagcaatgtcaacgaccgaccttgaggcatacttcaaagactgtttgtttaaagactgggaggagttgggggaggagattaggttaaaggtctttgtactaggaggctgtaggcataaattggtctgcgcaccagcaccatg

SEQ ID NO: 372 - DNA, 23 bp, Artificial Sequence
  ansb-1 primer
accttagaagatagccgcaaagc

SEQ ID NO: 373 - DNA, 25 bp, Artificial Sequence
  ansb-2 primer
cagagacatgacacccacgattatc

SEQ ID NO: 374 - DNA, 21 bp, Artificial Sequence
  ansb-3 primer
gcaaaccgctatccagaacga

SEQ ID NO: 375 - DNA, 24 bp, Artificial Sequence
  ansb-4 primer
agtttaagtatgccgtggtactgc

SEQ ID NO: 376 - DNA, 1217 bp, Salmonella typhimurium
  ansB (L-asparaginase II)
tggcgcagatcgtatctgcgcctttttattctgttttttcctgcattttgttatccatctctaaaaaatactctctgtcggatatatatcgctggttaatcgtatggcgtcacattattcgtctgcaatatagagataatgcgaccagttgacataactggagatataacatggagtttttcaggaaaacggcattagctgctctggtaatgggtttcagcggcgcagcgttcgctttaccgaatatcaccatcttagcgaccggcggaacgatcgctggcggtggtgattcagcaacaaaatcaaattatacggcaggtaaagtcggcgtcgaaaatctggtggatgccgttcctcaattgaaggacattgcggtagtgaaaggcgagcaggtcgttaacattggctcgcaggatatgaacgatgaagtctggctcacgctggcgaaaaaaatcaataccgagtgcgacagcaccgacggtttcgtgatcacccacggtactgatacgatggaagagaccgcttatttcctcgatctgaccgtgaaatgcaataaaccggtggtactggtcggcgcgatgcgtccttccacgtcaatgagcgcagatggcccgttcaacctctataatgcggtagtaacagcggctgataaacagtctgccaaccgcggcgtgctggtggtaatgaatgataccgtcatggacggacgcgacgtcactaagaccaatacgactgacgtggcgacgtttaaagcggttaactacggcccgctgggttatatccacaacggtaaaattgactaccagcgtacgccagagcgtaaacataccacctccaccccgttcgacgtgtcgaagctgaccgcgttgccgaaagtcggtatcgtttataactatgcgaatgcgtccgatctgccggcaaaagcgctggtagacgcgggttatgacgggatcgtgagcgcaggagtgggtaacggcaacctgtataaaacggtctttgataccctggcgaccgccgcgcacaacggtacggtagtggtgcgttcttcacgagtgccgactggcgcaaccacgcaggatgcggaagttgacgatgcaaaatacggctttgtcgcttccggcacgctgaacccgcaaaaagcgcgtgtcttactgcaactggcgttaacccagactaaagatccaaaacagatccagacgatgttcaatcagtattaa

SEQ ID NO: 377 - DNA, 3214 bp, Artificial Sequence
  Plasmid pSL0230
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggattgaccttagaagatagccgcaaagcgctggttggcagcctgaagtaatctttcctttttaaacaatggcgcagatcgtatctgcgcctttttattctgttttttcctgcattttgttatccatctctaaaaaatactctctgtcggatatatatcgctggttaatcgtatggcgtcacattattcgtctgcaatatagagataatgcgaccagttgacataactggagatataacatggctagcctcaataagcttcttgcctttctgcagaccaaggacccagattatgtgaagttgacgatgcaaaatacggctttgtcgcttccggcacgctgaacccgcaaaaagcgcgtgtcttactgcaactggcgttaacccagactaaagatccaaaacagatccagacgatgttcaatcagtattaaagataatgccccggtcggaaggccggggctatctttggaagacctctcgcacaaccaacactattatcttgctaattatcatcctggttatgataatcgtgggtgtcatgtctctggatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

What is claimed:

1. A modified Stimulator of Interferon Genes (STING) protein that is constitutively active so that type I interferon (IFN) is constitutively expressed, and has lower nuclear factor kappa-light-chain-enhancer of activated B cell (NF-κB) signaling pathway activity, compared to the NF-κB signaling pathway activity of human STING, wherein:

the STING protein comprises amino acid modifications that result in the constitutive production of type I IFN;

the amino acid modifications comprise one or more of an amino acid insertion, deletion, and replacement; and the modified STING protein is:

a) a modified non-human STING protein, wherein the non-human STING protein has lower activation of the NF-κB signaling pathway than human STING, and the non-human STING comprises one or more amino acid modifications that result in constitutive production of type I interferon; or b) a chimeric STING protein comprising a first species STING protein with replacement of the C-terminal tail (CTT) from a second species STING protein, wherein the second species STING protein has lower activation of the NF-κB signaling pathway than the first species STING, and the chimeric STING protein comprises one or more amino acid modifications that result in constitutive production of type I interferon; or c) the non-human STING protein of a) or the chimeric STING protein of b) that has a deletion in the tumor necrosis factor receptor associated factor 6 (TRAF6) binding site; or d) a modified STING protein that comprises one or more amino acid modifications that result in constitutive production of type I interferon, and comprises a modification that removes a phosphorylation site, whereby the modified STING protein has lower activation of the NF-κB signaling pathway than unmodified human STING, wherein the phosphorylation site occurs at residues corresponding to residues 324-326 with reference to SEQ ID NO:305.

2. The modified STING protein of claim 1 that is a chimeric STING that comprises a human STING in which the C-terminal tail (CTT) is replaced with a CTT from a non-human STING that has lower activation of the NF-κB signaling pathway than human STING.

3. The modified STING protein of claim 1, wherein the non-human species is selected from among Tasmanian devil, marmoset, cattle, cat, ostrich, boar, bat, manatee, crested ibis, coelacanth, and ghost shark.

4. The modified STING protein of claim 2, wherein the non-human species is selected from among Tasmanian devil, marmoset, cattle, cat, ostrich, boar, bat, manatee, crested ibis, coelacanth, and ghost shark.

5. The modified STING protein of claim 1, wherein:

the modification of STING is a mutation or mutations that correspond, by reference to and alignment with a human STING, to a mutation that promotes an interferonopathy; and the sequence of human STING is set forth in any of SEQ ID NOs: 305-309.

6. The modified STING protein of claim 1 that is a chimeric STING protein, wherein:

the chimeric STING protein comprises a portion of a human STING protein, and a C-terminal tail (CTT) from a non-human STING protein in place of the human CTT;

the non-human STING protein has attenuated activation of the NF-κB signaling pathway, compared to the activation of the NF-κB signaling pathway of human STING; and the chimeric STING protein is constitutively active so that type I IFN is constitutively expressed.

7. The modified STING protein of claim 1, wherein the unmodified STING protein is a human STING protein that comprises the sequence of amino acids set forth in any of SEQ ID NOs: 305-309, or is a human variant thereof with at least 98% sequence identity to the sequence of amino acids set forth in any of SEQ ID NOs: 305-309.

8. The modified STING protein of claim 1, wherein:

the STING protein is a chimera comprising replacement of a C-terminal tail (CTT) region in a STING protein from a first species with the CTT of a STING protein from a second species;

the STING protein of the second species has lower activation of the NF-κB signaling pathway than the activation of the NF-κB signaling pathway of human STING; and the TRAF6 binding site in the CTT optionally is deleted.

9. The modified STING protein of claim 8 that is a chimera comprising portions of STING proteins from two species, wherein the first species is human, and the second species is selected from among Tasmanian devil, marmoset, cattle, cat, ostrich, boar, bat, manatee, crested ibis, coelacanth, and ghost shark.

10. The modified STING protein of claim 8, wherein the replacing CTT is selected from among the following species and has a sequence:

```
Tasmanian devil
                                        SEQ ID NO: 353
RQEEFAIGPKRAMTVTTSSTLSQEPQLLISGMEQPLSLRTDGF,

Marmoset
                                        SEQ ID NO: 354
EEEEVTVGSLKTSEVPSTSTMSQEPELLISGMEKPLPLRSDLF,

Cow
                                        SEQ ID NO: 355
EREVTMGSTETSVMPGSSVLSQEPELLISGLEKPLPLRSDVF,

Cat
                                        SEQ ID NO: 356
EREVTVGSVGTSMVRNPSVLSQEPNLLISGMEQPLPLRTDVF,

Ostrich
                                        SEQ ID NO: 357
RQEEYTVCDGTLCSTDLSLQISESDLPQPLRSDCL,

Boar
                                        SEQ ID NO: 358
EREVTMGSAETSVVPTSSTLSQEPELLISGMEQPLPLRSDIF,

Bat
                                        SEQ ID NO: 359
EKEEVTVGTVGTYEAPGSSTLHQEPELLISGMDQPLPLRTDIF,

Manatee
                                        SEQ ID NO: 360
EREEVTVGSVGTSVVPSPSSPSTSSLSQEPKLLISGMEQPLPLR
TDVF,

Crested ibis
                                        SEQ ID NO: 361
CHEEYTVYEGNQPHNPSTTLHSTELNLQISESDLPQPLRSDCF,
```

-continued

```
Coelacanth (variant 1)
                                        SEQ ID NO: 362
QKEEYFMSEQTQPNSSSTSCLSTEPQLMISDTDAPHTLKRQVC,

Coelacanth (variant 2)
                                        SEQ ID NO: 363
QKEEYFMSEQTQPNSSSTSCLSTEPQLMISDTDAPHTLKSGF,
and

Ghost shark
                                        SEQ ID NO: 365
LIEYPVAEPSNANETDCMSSEPHLMISDDPKPLRSYCP,
```

or variants of each of these sequences having at least 98% sequence identity thereto.

11. The modified STING protein of claim 8, wherein the human STING CTT comprises the sequence EKEEVTVGSLKTSAVPSTSTMSQEPELLISGMEKPLPLRTDFS (SEQ ID NO:352), or is a variant having at least 98% sequence identity thereto.

12. The modified STING protein of claim 8, wherein the modified STING protein is a chimera in which the first species is a human and the second species is a Tasmanian devil, whereby the human STING CTT is replaced with a CTT from the Tasmanian devil STING.

13. The modified STING protein of claim 1 that is a chimeric protein that comprises human STING with a CTT from Tasmanian Devil STING and an amino acid replacement in the human portion that confers constitutive production of type I IFN on the STING protein.

14. The modified STING protein of claim 1, wherein the amino acid modification(s) that confer constitutive production of type I IFN is/are one or more amino acid replacements selected from replacements that correspond to S102P, V147L, V147M, N154S, V155M, G166E, C206Y, G207E, S102P/F279L, F279L, R281Q, R284G, R284S, R284M, R284K, R284T, R197A, D205A, R310A, R293A, T294A, E296A, R197A/D205A, S272A/Q273A, R310A/E316A, E316A, E316N, E316Q, S272A, R293A/T294A/E296A, D231A, R232A, K236A, Q273A, S358A/E360A/S366A, D231A/R232A/K236A/R238A, S358A, E360A, S366A, R238A, R375A, and S324A/S326A, with reference to the sequence of human STING, as set forth in any one of SEQ ID NOs: 305-309.

15. The modified STING protein of claim 1, comprising a replacement corresponding to C206Y or R284G, with reference to the sequence of human STING as set forth in any of SEQ ID NOs: 305-309.

16. The modified STING protein of claim 1, comprising the sequence of amino acids set forth in any of SEQ ID NOs: 332-336 or a sequence having at least 98% sequence identity with a sequence set forth any of SEQ ID NOs: 332-336.

17. The modified STING protein of claim 1, wherein the sequence of the unmodified STING protein comprises a sequence set forth in SEQ ID NOs: 305-309, 331, 338 and 341-350, or a sequence having at least 98% sequence identity to any of the STING proteins set forth in any of SEQ ID NOs: 305-309, 331, 338 and 341-350.

18. A delivery vehicle, comprising the modified STING protein of claim 1.

19. The delivery vehicle of claim 18 that is selected from among a nanoparticle, a liposome, an exosome, a bacterium, a virus, a cell, and a microvesicle.

20. An immunostimulatory bacterium, comprising the modified STING protein of claim 1.

21. The immunostimulatory bacterium of claim 20, wherein the bacterium comprises modification of the genome whereby Toll-Like Receptor 2 (TLR2), TLR4, and TLR5 recognition is reduced compared to the bacterium that does not have the genome modifications.

22. The immunostimulatory bacterium of claim 20, wherein:

the bacterium comprises genome modifications whereby the bacterium lacks flagella and comprises penta-acylated lipopolysaccharide; and the wild-type bacterium has flagella.

23. The immunostimulatory bacterium of claim 20, wherein the bacterium comprises genome modifications whereby the bacterium is $pagP^-/msbB^-$.

24. The immunostimulatory bacterium of claim 22, wherein the immunostimulatory bacterium comprises genome modifications whereby the bacterium is one or more of $purI^-$, $purD^-$, $adrA^-$, $csgD^-$, $qseC^-$, $hilA^-$, $lppA^-$, and $lppB^-$.

25. The immunostimulatory bacterium of claim 20 that further comprises an immunostimulatory protein, that, when expressed in a mammalian subject, confers or contributes to anti-tumor immunity in the tumor microenvironment.

26. The immunostimulatory bacterium of claim 25, wherein the immunostimulatory protein is one or more of a cytokine, a chemokine, a co-stimulatory protein, a co-stimulatory receptor, or a co-stimulatory receptor with the cytoplasmic domain deleted.

27. The immunostimulatory bacterium claim 25, wherein the immunostimulatory protein is one or more of interleukin-2 (IL-2), IL-7, IL-12p70 (IL-12p40+IL-12p35), IL-15, IL-15/IL-15R alpha chain complex, IL-2 that has attenuated binding to IL-2Ra, IL-2 modified so that it does not bind to IL-2Ra, IL-18, IL-36 gamma, CXCL9, CXCL10, CXCL11, chemokine (C-C motif) ligand 3 (CCL3), CCL4, CCL5, proteins that are involved in or that effect or potentiate recruitment/persistence of T cells, CD40, CD40 Ligand (CD40L), OX40, OX40 Ligand (OX40L), 4-1BB, 4-1BB Ligand (4-1BBL), members of the B7-CD28 family, a TGF-beta polypeptide antagonist, and members of the tumor necrosis factor receptor (TNFR) superfamily.

28. The immunostimulatory bacterium of claim 22, wherein the bacterium is a strain of *Salmonella, Shigella, Escherichia coli*, Bifidobacteriae, *Rickettsia, Vibrio, Listeria, Klebsiella, Bordetella, Neisseria, Aeromonas, Francisella, Cholera, Corynebacterium, Citrobacter, Chlamydia, Haemophilus, Brucella, Mycobacterium, Mycoplasma, Legionella, Rhodococcus, Pseudomonas, Helicobacter, Bacillus*, or *Erysipelothrix*, or an attenuated strain thereof or a modified strain thereof of any of the preceding list of bacterial strains.

29. The immunostimulatory bacterium of claim 28 that is a strain of *Salmonella.*

30. The immunostimulatory bacterium of claim 29 that is a *Salmonella typhimurium* strain.

31. An isolated cell, comprising the delivery vehicle of claim 18.

32. The cell of claim 31 that is an immune cell, a stem cell, a tumor cell, or a primary cell.

33. A pharmaceutical composition, comprising the modified STING protein of claim 1 or comprising an immunostimulatory bacterium comprising the modified STING protein in a pharmaceutically acceptable vehicle.

34. The modified STING protein of claim 16, comprising the sequence of amino acids set forth in SEQ ID NO:335 or a sequence having at least 98% sequence identity with the sequence set forth in SEQ ID NO:335.

35. The modified STING protein of claim 1, wherein the tumor necrosis factor receptor associated factor 6 (TRAF6) binding site of the modified STING protein is deleted.

36. The modified STING protein of claim 16, wherein the TRAF6 binding site is deleted.

37. The modified STING protein of claim 36, comprising the sequence of amino acids set forth in SEQ ID NO:336 or a sequence having at least 98% sequence identity with the sequence set forth in SEQ ID NO:336.

38. The modified STING protein of claim 16, wherein the amino acid modification(s) that confer constitutive production of type I IFN comprise or further comprise one or more amino acid replacements selected from replacements that correspond to S102P, V147L, V147M, N154S, V155M, G166E, C206Y, G207E, S102P/F279L, F279L, R281Q, R284G, R284S, R284M, R284K, R284T, R197A, D205A, R310A, R293A, T294A, E296A, R197A/D205A, S272A/Q273A, R310A/E316A, E316A, E316N, E316Q, S272A, R293A/T294A/E296A, D231A, R232A, K236A, Q273A, S358A/E360A/S366A, D231A/R232A/K236A/R238A, S358A, E360A, S366A, R238A, R375A, and S324A/S326A, with reference to the sequence of human STING, as set forth in any one of SEQ ID NOs: 305-309.

39. The modified STING protein of claim 1, wherein:

the modified STING protein comprises a mutation that eliminates a phosphorylation site in the STING protein to thereby reduce activation of the NF-κB signaling pathway; and the phosphorylation site occurs at residues corresponding to residues 324-326 with reference to SEQ ID NO:305.

* * * * *